(12) United States Patent
Ganesan et al.

(10) Patent No.: US 11,965,024 B2
(45) Date of Patent: Apr. 23, 2024

(54) METHODS AND COMPOSITIONS FOR MODULATING BETA CHAIN MEDIATED IMMUNITY

(71) Applicant: JANSSEN BIOTECH, INC., Horsham, PA (US)

(72) Inventors: Rajkumar Ganesan, Blue Bell, PA (US); Iqbal S. Grewal, Newtown, PA (US); Sanjaya Singh, Blue Bell, PA (US); Michael Riis Hansen, Broomall, PA (US)

(73) Assignee: Janssen Biotech, Inc., Horsham, PA (US)

(*) Notice: Subject to any disclaimer, the term of this patent is extended or adjusted under 35 U.S.C. 154(b) by 7 days.

(21) Appl. No.: 17/472,198

(22) Filed: Sep. 10, 2021

(65) Prior Publication Data

US 2022/0089731 A1 Mar. 24, 2022

Related U.S. Application Data

(60) Provisional application No. 63/237,972, filed on Aug. 27, 2021, provisional application No. 63/176,112, filed on Apr. 16, 2021, provisional application No. 63/165,053, filed on Mar. 23, 2021, provisional application No. 63/142,940, filed on Jan. 28, 2021, provisional application No. 63/142,930, filed on Jan. 28, 2021, provisional application No. 63/142,944, filed on Jan. 28, 2021, provisional application No. 63/104,220, filed on Oct. 22, 2020, provisional application No. 63/104,247, filed on Oct. 22, 2020, provisional application No. 63/104,265, filed on Oct. 22, 2020, provisional application No. 63/077,387, filed on Sep. 11, 2020, provisional application No. 63/077,314, filed on Sep. 11, 2020, provisional application No. 63/077,397, filed on Sep. 11, 2020.

(51) Int. Cl.
| | |
|---|---|
| *C07K 16/28* | (2006.01) |
| *A61K 39/00* | (2006.01) |
| *A61P 35/00* | (2006.01) |
| *C07K 16/30* | (2006.01) |
| *C12N 5/0783* | (2010.01) |

(52) U.S. Cl.
CPC .......... *C07K 16/2809* (2013.01); *A61P 35/00* (2018.01); *C07K 16/28* (2013.01); *C07K 16/2866* (2013.01); *C07K 16/2878* (2013.01); *C07K 16/3069* (2013.01); *C12N 5/0636* (2013.01); *A61K 2039/505* (2013.01); *C07K 2317/24* (2013.01); *C07K 2317/31* (2013.01); *C07K 2317/35* (2013.01); *C07K 2317/565* (2013.01); *C07K 2317/92* (2013.01)

(58) Field of Classification Search
CPC ................................................ C07K 16/2809
See application file for complete search history.

(56) References Cited

U.S. PATENT DOCUMENTS

| | | | |
|---|---|---|---|
| 6,084,087 A | 7/2000 | Friedman | |
| 6,221,352 B1* | 4/2001 | Howell | A61K 39/0008 424/1.49 |
| 6,413,516 B1* | 7/2002 | Chang | A61P 37/02 514/19.3 |
| 6,521,427 B1 | 2/2003 | Evans | |
| 6,670,127 B2 | 12/2003 | Evans | |
| 6,737,056 B1 | 5/2004 | Presta | |
| 9,168,314 B2 | 10/2015 | Satijn et al. | |
| 2006/0286104 A1 | 12/2006 | Hanke | |
| 2009/0182127 A1 | 7/2009 | Kristian | |
| 2010/0015133 A1 | 1/2010 | Tomoyuki | |
| 2010/0028637 A1 | 2/2010 | Tavsanli | |
| 2011/0123532 A1 | 5/2011 | Gurney | |
| 2012/0149876 A1 | 6/2012 | Von Kreudenstein | |
| 2013/0195849 A1 | 8/2013 | Spreter Von Kreudenstein | |
| 2013/0230540 A1 | 9/2013 | Holmes | |
| 2016/0053020 A1 | 2/2016 | Verploegen | |
| 2016/0347858 A1 | 12/2016 | Sakamoto | |
| 2017/0015738 A1 | 1/2017 | Pedersen | |
| 2017/0088620 A1 | 3/2017 | Nioi | |
| 2022/0089737 A1 | 3/2022 | Ganesan et al. | |

FOREIGN PATENT DOCUMENTS

| | | |
|---|---|---|
| WO | 2006028936 | 3/2006 |
| WO | 2011014469 A1 | 2/2011 |
| WO | 2011131746 A2 | 10/2011 |
| WO | 2016073845 | 5/2016 |
| WO | 2018015340 | 1/2018 |
| WO | 2018223002 | 12/2018 |
| WO | 2019091384 | 5/2019 |
| WO | 2019246286 A1 | 12/2019 |
| WO | 2020010250 | 1/2020 |

(Continued)

OTHER PUBLICATIONS

Mccarthy et al. (J. Immunol. Methods, 251(1-2): 137-149, 2001) (Year: 2001).*
Lin et al. (African Journal of Biotechnology, 10(79):18294-18302, 2011) (Year: 2011).*
Al-Lazikani et al., "Standard conformations for the canonical structures of immunoglobulins", J. Mol. Biol. 273:927-948 (1997).
Atwell et al. "Stable Heterodimers from Remodeling the Domain Interface of a Homodimer using a Phage Display Library," Journal of Molecular Biology, vol. 270, 1997, 26-35.
Brown et al., "A Study of the Interactions Between an IgG-Binding Domain Based on the B Domain of *Staphylococcal* Protein A and Rabbit IgG", Mol. Biotech. 10:9-16, 1998.

(Continued)

*Primary Examiner* — Gregory S Emch
*Assistant Examiner* — Ashley H. Gao
(74) *Attorney, Agent, or Firm* — Ice Miller LLP

(57) ABSTRACT

Anti-Vβ17 antibodies or antigen binding fragments thereof are described. Also described are nucleic acids encoding the antibodies, compositions comprising the antibodies, methods of producing the antibodies, and methods of using the antibodies for treating or preventing diseases.

34 Claims, 38 Drawing Sheets

Specification includes a Sequence Listing.

(56) References Cited

FOREIGN PATENT DOCUMENTS

| WO | 2020142672 | | 7/2020 |
|---|---|---|---|
| WO | 2020183245 | A2 | 9/2020 |
| WO | 2020257760 | A1 | 12/2020 |
| WO | 2021064671 | A1 | 4/2021 |

OTHER PUBLICATIONS

Ferrara et al., "Modulation of Therapeutic Antibody Effector Functions by Glycosylation Engineering: Influence of Golgi Enzyme Localization Domain and Co-Expression of Heterolgous B1, 4-N-acetylglucosaminyltransferase III and Golgi m-mannodsidase II", Biotechnol Bioeng 93:851-861, 2006.

Ferrara et al., "The carbohydrate at FCYRIIIa Asn-162; An element required for high affinity binding to non-fucosylated IgG glycoforms", J Biol Chem 281:5032-5036, 2006.

Fransson J, et al. "Human framework adaptation of a mouse anti-human IL-13 antibody", J. Mol. Biol. 2010; 398:214-231.

Kabat et al., "Unusual distributions of amino acids in complementarity-determining (hypervariable) segments of heavy and light chains of immunoglobulins and their possible roles in specificity of antibody-combining sites", J. Biol. Chem. 252:6609-6616 (1977).

Kabat, Elivin A. "The Structural Basis of Antibody Complementarity," Adv. Prot. Chem. 32:1-75 (1978).

Kawasaki et al., "Presence of four major haplotypes in human BCMA gene: lack of association with systemic lupus erythematosus and rheumatoid arthritis", Genes Immun. 2:276-9, 2001.

Konno et al., "Fucose content of monoclonal antibodies can be controlled by culture medium osmolality for high antibody-dependent cellular cytotoxicity", Cytotechnology 64:249-65, 2012.

Lefranc et al., "IMGT unique numbering for immunoglobulin and T cell receptor variable domains and Ig superfamily V-like domains", Dev. Comp. Immunol. 27(1):55-77 (2003).

Morea et al., "Antibody Modeling: Implications for Engineering and Design," Methods, vol. 20, 2000; pp. 267-279.

Mori et al., "Engineering Chinese hamster ovary cells to maximize effector function of produced antibodies using FUT8 siRNA", Biotechnol Bioeng 88:901-908, 2004.

Olivier et al., "EB66 cell line, a duck embryonic stem cell-derived substrate for the industrial production of therapeutic monoclonal antibodies with enhanced ADCC activity", MAbs; 2(4), 2010.

Osborn, et al., "High-Affinity IgG antibodies develop naturally in Ig-knockout rats carrying germline human IgH/lgk/Igy loci bearing the rat CH region", J Immunol, 2013, 190(4): 1481-90.

Shields et al., "Lack of fucose on human IgG1 N-Linked oligosaccharide improves binding to human FCYRIII and antibody-dependent cellular toxicity", J Biol Chem 277:26733-26740, 2002.

Shinkawa et al., "The absence of fucose but not the presence of galactose or bisection N-Acetylglucosamine of human IgG1 complex-type oligosaccharides shows the critical role of enhancing antibody-dependent cellular cytotoxicity", J Biol Chem 278:3466-3473, 2003.

Zhou et al., "Development of a simple and rapid method for producing non-fucosylated oligomannose containing antibodies with increased effector function", Biotechnol Bioeng 99:652-65, 2008.

Garfall, Alfred L et al. "Three is a charm for an antibody to fight cancer," Nature, vol. 575 (Nov. 2019) pp. 450-451.

* cited by examiner

| Donor | HLA status | % of Vβ17⁺ in CD8 T cells (Day 0) | % of Vβ17⁺ in CD8 T cells (Day 14) |
|---|---|---|---|
| HPU-03033 | A2 | 5.45 | 14.4 |
| HPU-07540 | A2 | 3.70 | 34.4 |
| HPU-08694 | A2 | 3.88 | 75 |
| 17043595 | A*0201 | 2 | 15 |
| 14035473 | A*0201 | 2.8 | 40.7 |
| 15036948 | A*0201 | 3.64 | 43.0 |

- VB1: NULLXCD123
- Vβ17XCD123 HI: Heat denatured Vβ17XCD123 (at 95°C for 6 minutes)

| αβ T-cell binding | | | αβ T-cell mediated cytotoxicity of H929 tumor cells | | |
|---|---|---|---|---|---|
| Compound ID | Description | nM EC50 | Compound ID | Description | nM EC50 |
| B17B622.001 | Vb17_202B4D1-Fab-RF, BCMB519-scFv | 4.9 | B17B622.001 | Vb17_202B4D1-Fab-RF, BCMB519-scFv | 4.9 |

| αβ T-cell binding | | | αβ T-cell mediated cytotoxicity of H929 tumor cells | | |
|---|---|---|---|---|---|
| Compound ID | Description | nM EC50 | Compound ID | Description | nM EC50 |
| B17B612.002 | B21M-Fab-RF x BCMB519-LH-scFv (control) | 0 | B17B612.002 | B21M-Fab-RF x BCMB519-LH-scFv (control) | 0 |

FIG. 13

| % Dead Target Cells | | | % CD25+ T Cells | | |
|---|---|---|---|---|---|
| Compound ID | Description | nM EC50 | Compound ID | Description | nM EC50 |
| B17B621.001 | Va10.2-TRVAB1-Fab-RF, BCMB519-scFv | 0.162 | B17B621.001 | Va10.2-TRVAB1-Fab-RF, BCMB519-scFv | 0.484 |

| % Dead Target Cells | | | % CD25+ T Cells | | |
|---|---|---|---|---|---|
| Compound ID | Description | nM EC50 | Compound ID | Description | nM EC50 |
| B17B627.001 | Va10.2-TRVAB2-Fab-RF, BCMB519-scFv | 1.65 | B17B627.001 | Va10.2-TRVAB2-Fab-RF, BCMB519-scFv | 5.84 |

METHODS AND COMPOSITIONS FOR MODULATING BETA CHAIN MEDIATED IMMUNITY

CROSS-REFERENCE TO RELATED APPLICATIONS

This application claims the benefit of U.S. Ser. No. 63/077,314 filed Sep. 11, 2020; U.S. Ser. No. 63/077,397 filed Sep. 11, 2020; U.S. Ser. No. 63/077,387 filed Sep. 11, 2020; U.S. Ser. No. 63/104,220 filed Oct. 22, 2020; U.S. Ser. No. 63/104,247 filed Oct. 22, 2020; U.S. Ser. No. 63/104,265 filed Oct. 22, 2020; U.S. Ser. No. 63/142,930 filed Jan. 28, 2021; U.S. Ser. No. 63/142,940 filed Jan. 28, 2021; U.S. Ser. No. 63/142,944 filed Jan. 28, 2021; U.S. Ser. No. 63/165,053 filed Mar. 23, 2021; U.S. Ser. No. 63/176,112 filed Apr. 16, 2021; and U.S. Ser. No. 63/237,972 filed Aug. 27, 2021, the disclosure of each of which is incorporated by reference herein in its entirety.

FIELD

This invention relates to, among other things, anti-Vβ17 molecules, including anti-Vβ17 antibodies, bispecific antibodies, nucleic acids and expression vectors encoding the antibodies, recombinant cells containing the vectors, and compositions comprising the antibodies. Methods of making the antibodies, and methods of using the antibodies to modulate an immune response, are also provided.

Reference to Sequence Listing Submitted Electronically

This application contains a sequence listing, which is submitted electronically via EFS-Web as an ASCII formatted sequence listing with a file "14620-406-999_SL.txt" and a creation date of Sep. 5, 2021 and having a size of 889,895 bytes. The sequence listing submitted via EFS-Web is part of the specification and is herein incorporated by reference in its entirety.

SUMMARY

In one aspect, provided herein is an antibody that binds to T Cell Receptor Beta Variable 17 (Vβ17).

In one aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:21; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:677. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:77; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:78. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:79; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:80. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:81; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:82. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:83; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:84. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:85; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:86. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:87; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:88. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1000; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1001. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1032; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1033. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1064; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1065. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1096; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1097. In another aspect, provided is an antibody that binds to Vβ17, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1128; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1129. In some embodiments, the VH CDR1, VH CDR2, VH CDR3, VL CDR1, VL CDR2, and VL CDR3 amino acid sequences are according to the Kabat numbering system. In some embodiments, the VH CDR1, VH CDR2, VH CDR3, VL CDR1, VL CDR2, and VL CDR3 amino acid sequences are according to the Chothia numbering system. In some embodiments, the VH CDR1, VH CDR2, VH CDR3, VL CDR1, VL CDR2, and VL CDR3 amino acid sequences are according to the AbM numbering system. In some embodiments, the VH CDR1, VH CDR2, VH CDR3, VL CDR1, VL CDR2, and VL CDR3 amino acid sequences are according to the Contact numbering system. In some embodiments, the VH CDR1, VH CDR2, VH CDR3, VL CDR1, VL CDR2, and VL CDR3 amino acid sequences are according to the IMGT numbering system. In some embodiments, the VH CDR1, VH CDR2, VH CDR3, VL CDR1, VL CDR2, and VL CDR3 amino acid sequences are according to the Exemplary numbering system.

In some embodiments of the Vβ17 antibodies provided herein, the antibody is a humanized antibody. In some embodiments, the antibody is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody. In some embodiments, the antibody comprises a kappa light chain. In some embodiments, the antibody comprises a lambda light chain. In some embodiments, the antibody is a monoclonal antibody.

In some embodiments of the Vβ17 antibodies provided herein, the antibody binds a Vβ17 antigen. In some embodiments, the antibody binds a Vβ17 epitope. In some embodiments, the antibody specifically binds to Vβ17. In some embodiments, the VH CDR1, VH CDR2, VH CDR3, VL CDR1, VL CDR2 and VL CDR3 form a binding site for an antigen of the Vβ17. In some embodiments, the VH CDR1, VH CDR2, VH CDR3, VL CDR1, VL CDR2 and VL CDR3 form a binding site for an epitope of the Vβ17. In some embodiments, the Vβ17 is present on the surface of a T cell.

In some embodiments of the Vβ17 antibodies provided herein, the antibody is multivalent. In some embodiments, the antibody is capable of binding at least three antigens. In some embodiments, the antibody is capable of binding at least four antigens. In some embodiments, the antibody is capable of binding at least five antigens. In some embodiments of the Vβ17 antibodies provided herein, the antibody is a multispecific antibody.

In another aspect, provided is a multispecific Vβ17 antibody, comprising (a) a first binding domain that binds to Vβ17, wherein the first binding domain comprises a Vβ17 antibody provided herein, and (b) a second binding domain that binds to a second target that is not Vβ17.

In some embodiments of the multispecific Vβ17 antibodies provided herein, the antibody is a bispecific antibody. In some embodiments, the antibody is a trispecific antibody. In some embodiments, the antibody is a quadraspecific antibody.

In some embodiments of the multispecific Vβ17 antibodies provided herein, the second binding domain binds an antigen of the second target. In some embodiments, the second binding domain binds an epitope of the second target. In some embodiments, the second binding domain specifically binds to the second target. In some embodiments, the VH CDR1, VH CDR2, VH CDR3, VL CDR1, VL CDR2 and VL CDR3 of the second binding domain form a binding site for an antigen of the second target. In some embodiments, the VH CDR1, VH CDR2, VH CDR3, VL CDR1, VL CDR2 and VL CDR3 of the second binding domain form a binding site for an epitope of the second target. In some embodiments, the second target is present on the surface of a target cell. In some embodiments, the second binding domain that binds the second target is multivalent. In some embodiments, the second binding domain is capable of binding at least three antigens. In some embodiments, the second binding domain is capable of binding at least four antigens. In some embodiments, the second binding domain is capable of binding at least five antigens.

In some embodiments of the multispecific Vβ17 antibodies provided herein, the second target is CD123. In some embodiments, the second binding arm that binds CD123 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:40; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:41. In another aspect, provided is a multispecific antibody that binds to Vβ17, comprising: (a) a first binding domain that binds to Vβ17, wherein the first binding domain comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:25; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:26; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:7; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:8; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:9; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:10; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:19; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:22; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:19; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:23; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:19; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:24; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:20; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:22; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:20; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:23; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:20; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:24; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:21; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:22; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:21; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:23; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:21; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:24; and (b) a second binding domain that binds to a second target that is BCMA, DLL3, PSMA or KLK2. In another aspect, provided is a multispecific antibody that binds to Vβ17, comprising: (a) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:46; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:49; and (b) a second binding domain that binds to a second target that is BCMA, DLL3, PSMA or KLK2. In some embodiments, the VH CDR1, VH CDR2, VH CDR3, VL CDR1, VL CDR2, and VL CDR3 amino acid sequences of the first binding arm are according to the Kabat numbering system. In some embodiments, the VH CDR1, VH CDR2, VH CDR3, VL CDR1, VL CDR2, and VL CDR3 amino acid sequences of the first binding arm are according to the Chothia numbering system. In some embodiments, the VH CDR1, VH CDR2, VH CDR3, VL CDR1, VL CDR2, and VL CDR3 amino acid sequences of the first binding arm are according to the AbM numbering system. In some embodiments, the VH CDR1, VH CDR2, VH CDR3, VL CDR1, VL CDR2, and VL CDR3 amino acid sequences of the first binding arm are according to the Contact numbering system. In some embodiments, the VH CDR1, VH CDR2, VH CDR3, VL CDR1, VL CDR2, and VL CDR3 amino acid sequences of the first binding arm are according to the IMGT numbering system. In some embodiments, the VH CDR1, VH CDR2, VH CDR3, VL CDR1, VL CDR2, and VL CDR3 amino acid sequences of the first binding arm are according to the Exemplary numbering system.

In some embodiments of the multispecific Vβ17 antibodies provided herein, the second target is BCMA. In some embodiments, the second binding arm that binds BCMA comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:95; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:96.

In some embodiments of the multispecific Vβ17 antibodies provided herein, the second target is DLL3. In some embodiments, the second binding arm that binds DLL3 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:694; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:695.

In some embodiments of the multispecific Vβ17 antibodies provided herein, the second target is PSMA. In some embodiments, the second binding arm that binds PSMA comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:730; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:731. In some embodiments, the second binding arm that binds PSMA comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:732; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:733. In some embodiments, the second binding arm that binds PSMA comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:734; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:735. In some embodiments, the second binding arm that binds PSMA comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:736; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:737. In some embodiments, the second binding arm that binds PSMA comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:899; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:900.

In some embodiments of the multispecific Vβ17 antibodies provided herein, the second target is KLK2. In some embodiments, the second binding arm that binds KLK2 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:887; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:888.

In some embodiments of the multispecific Vβ17 antibodies provided herein, the VH CDR1, VH CDR2, VH CDR3, VL CDR1, VL CDR2, and VL CDR3 amino acid sequences of the second binding arm are according to the Kabat numbering system. In some embodiments, the VH CDR1, VH CDR2, VH CDR3, VL CDR1, VL CDR2, and VL CDR3 amino acid sequences of the second binding arm are according to the Chothia numbering system. In some embodiments, the VH CDR1, VH CDR2, VH CDR3, VL CDR1, VL CDR2, and VL CDR3 amino acid sequences of the second binding arm are according to the AbM numbering system. In some embodiments, the VH CDR1, VH CDR2, VH CDR3, VL CDR1, VL CDR2, and VL CDR3 amino acid sequences of the second binding arm are according to the Contact numbering system. In some embodiments, the VH CDR1, VH CDR2, VH CDR3, VL CDR1, VL CDR2, and VL CDR3 amino acid sequences of the second binding arm are according to the IMGT numbering system. In some embodiments, the VH CDR1, VH CDR2, VH CDR3, VL CDR1, VL CDR2, and VL CDR3 amino acid sequences of the second binding arm are according to the Exemplary numbering system.

In another aspect, provided is a multispecific Vβ17 antibody, comprising a first means capable of binding Vβ17 on the surface of the T cell; and a second means capable of binding a second target that is not Vβ17. In some embodiments, the second target is present on the surface of a target cell.

In another aspect, provided is a nucleic acid encoding a Vβ17 antibody provided herein. In another aspect, provided is a vector comprising the nucleic acid encoding a Vβ17 antibody provided herein. In another aspect, provided is a host cell comprising a vector comprising the nucleic acid encoding a Vβ17 antibody provided herein.

In another aspect, provided is a kit comprising a vector comprising the nucleic acid encoding a Vβ17 antibody provided herein. In another aspect, provided is a kit comprising a Vβ17 antibody provided herein and packaging for the same. In another aspect, provided is a pharmaceutical composition comprising a Vβ17 antibody provided herein, and a pharmaceutically acceptable carrier. In another aspect, provided is a method of producing a pharmaceutical composition comprising a Vβ17 antibody provided herein, and a pharmaceutically acceptable carrier, the method comprising combining the antibody with a pharmaceutically acceptable carrier to obtain the pharmaceutical composition.

In another aspect, provided is a method of activating a T cell expressing Vβ17, comprising contacting the T cell with a Vβ17 antibody provided herein. In some embodiments, the contacting results in an increase in CD69, CD25, and/or Granzyme B expression, as compared to a control T cell expressing Vβ17.

In another aspect, provided is a process for making an antibody that binds to more than one target molecule, the process comprising: a step for performing a function of obtaining a first binding domain that binds to Vβ17 present on a T cell; a step for performing a function of obtaining a second binding domain that binds to a second target on the surface of a target cell; and a step for performing a function of providing an antibody that binds to Vβ17 present on a T cell and a second target on the surface of a target cell. In some embodiments, the step for performing a function of obtaining a second binding domain that binds to a second target on the surface of a target cell is repeated n times, and further comprising n steps for performing a function of providing a first binding domain that binds to Vβ17 present on a T cell and n number of target molecules, wherein n is at least 2.

In another aspect, provided is a method of directing a T cell expressing Vβ17 to a target cell, comprising contacting a multispecific Vβ17 antibody provided herein with the target cell, wherein the second target is present on the surface of the target cell, and wherein the contacting directs the T cell to the target cell.

In another aspect, provided is a method of inhibiting the growth of a target cell, comprising contacting a multispecific Vβ17 antibody provided herein with the target cell having the second target present on the surface of the target cell, wherein the contacting is in the presence of a T cell expressing the Vβ17, and wherein the contacting results in the inhibition of the growth of the target cell. In another aspect, provided is a method of inhibiting the proliferation of a target cell, comprising contacting a multispecific Vβ17 antibody provided herein with the target cell having the second target present on the surface of the target cell, wherein the contacting is in the presence of a T cell expressing the Vβ17, and wherein the contacting results in the inhibition of the proliferation of the target cell.

In another aspect, provided is a method of eliminating a target cell in a subject, comprising contacting a multispecific Vβ17 antibody provided herein with the target cell having the second target present on the surface of the target cell, wherein the contacting is in the presence of a T cell expressing the Vβ17, and wherein the contacting results in the elimination of the target cell. In another aspect, provided is a method of treating a disease in a subject, comprising administering an effective amount of a multispecific Vβ17 antibody provided herein to the subject, wherein the disease is caused all or in part by a target cell having the second target present on the surface of the target cell. In some embodiments, the subject is a human. In some embodiments, the subject is a subject in need thereof.

In some embodiments, the second target is present on the surface of a target cell, and wherein the target cell is a cancer cell. In some embodiments, the cancer cell is a cell of an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer. In some embodiments, the second target is angiopoietin, BCMA, CD19, CD20, CD22, CD25 (IL2-R), CD30, CD33, CD37, CD38, CD52, CD56, CD123 (IL-3R), cMET, DLL/Notch, EGFR, EpCAM, FGF, FGF-R, GD2, HER2, Mesothelin, Nectin-4, PAP, PDGFRα, PSA, PSA3, PSMA, RANKL, SLAMF7, STEAP1, TARP, TROP2, VEGF, or VEGF-R. In some embodiments, the second target is CEA, immature laminin receptor, TAG-72, HPV E6, HPV E7, BING-4, calcium-activated chloride channel 2, cyclin-B1, 9D7, EpCAM, EphA3, Her2/neu, telomerase, mesothelin, SAP-1, surviving, a BAGE family antigen, CAGE family antigen, GAGE family antigen, MAGE family antigen, SAGE family antigen, XAGE family antigen, NY-ESO-1/LAGE-1, PRAME, SSX-2, Melan-A, MART-1, Gp100, pmel17, tyrosinase, TRP-1, TRP-2, P. polypeptide, MC1R, prostate-specific antigen, β-catenin, or BRCA1.

In some embodiments, the second target is CD123. In some embodiments, the second target is BCMA. In some embodiments, the second target is DLL3. In some embodiments, the second target is PSMA. In some embodiments, the second target is KLK2.

In some embodiments, (i) the adrenal cancer is an adrenocortical carcinoma (ACC), adrenal cortex cancer, pheochromocytoma, or neuroblastoma; (ii) the anal cancer is a squamous cell carcinoma, cloacogenic carcinoma, adenocarcinoma, basal cell carcinoma, or melanoma; (iii) the appendix cancer is a neuroendocrine tumor (NET), mucinous adenocarcinoma, goblet cell carcinoid, intestinal-type adenocarcinoma, or signet-ring cell adenocarcinoma; (iv) the bile duct cancer is an extrahepatic bile duct cancer, adenocarcinomas, hilar bile duct cancer, perihilar bile duct cancer, distal bile duct cancer, or intrahepatic bile duct cancer; (v) the bladder cancer is transitional cell carcinoma (TCC), papillary carcinoma, flat carcinoma, squamous cell carcinoma, adenocarcinoma, small-cell carcinoma, or sarcoma; (vi) the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer; (vii) the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma; (viii) the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer; (ix) the cervical cancer is a squamous cell carcinoma, or adenocarcinoma; (x) the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma; (xi) the esophageal cancer is an adenocarcinoma or squamous cell carcinoma; (xii) the gall bladder cancer is an adenocarcinoma, papillary adenocarcinoma, adenosquamous carcinoma, squamous cell carcinoma, small cell carcinoma, or sarcoma; (xiii) the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT); (xiv) the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer; (xv) the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL); (xvi) the intestinal cancer is a small intestine cancer, small bowel cancer, adenocarcinoma, sarcoma, gastrointestinal stromal tumors, carcinoid tumors, or lymphoma; (xvii) the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma; (xviii) the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS); (xix) the liver cancer is a hepatocellular carcinoma (HCC), fibrolamellar HCC, cholangiocarcinoma, angiosarcoma, or liver metastasis; (xx) the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor; (xxi) the melanoma is a superficial spreading melanoma, nodular melanoma, acral-lentiginous melanoma, lentigo maligna melanoma, amelanotic melanoma, desmoplastic melanoma, ocular melanoma, or metastatic melanoma; (xxii) the mesothelioma is a pleural mesothelioma, peritoneal mesothelioma, pericardial mesothelioma, or testicular mesothelioma; (xxiii) the multiple myeloma is an active myeloma or smoldering myeloma; (xxiv) the neuroendocrine tumor, is a gastrointestinal neuroendocrine tumor, pancreatic neuroendocrine tumor, or lung neuroendocrine tumor; (xxv) the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma; (xxvi) the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma acuminatum, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer; (xxvii) the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst; (xxviii) the pancreatic cancer is a pancreatic exocrine gland cancer, pancreatic endocrine gland cancer, or pancreatic adenocarcinoma, islet cell tumor, or neuroendocrine tumor; (xxix) the prostate cancer is a prostate adenocarcinoma, prostate sarcoma, transitional cell carcinoma, small cell carcinoma, or neuroendocrine tumor; (xxx) the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer; (xxxi) the skin cancer is a basal cell carcinoma, squamous cell carcinoma, melanoma, Merkel cell carcinoma, Kaposi sarcoma (KS), actinic keratosis, skin lymphoma, or keratoacanthoma; (xxxii) the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma; (xxxiii) the spinal cancer is a spinal metastatic tumor; (xxxiv) the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid; (xxxv) the testicular cancer is a seminoma, non-seminoma, embryonal carcinoma, yolk sac carcinoma, choriocarcinoma, teratoma, gonadal stromal tumor, leydig cell tumor, or sertoli cell tumor; (xxxiv) the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer; (xxxv) the thyroid cancer is a papillary carcinoma, follicular carcinoma, Hürthle cell carcinoma, medullary thyroid carcinoma, or anaplastic carcinoma; (xxxvi) the uterine cancer is an endometrial cancer, endometrial adenocarcinoma, endometroid carcinoma, serous adenocarcinoma, adenosquamous carcinoma, uterine carcinosarcoma, uterine sarcoma, uterine leiomyosarcoma, endometrial stromal sarcoma, or undifferentiated sarcoma; (xxxvii) the vaginal cancer is a squamous cell carcinoma, adenocarcinoma, melanoma, or sarcoma; or (xxxviii) the vulvar cancer is a squamous cell carcinoma or adenocarcinoma.

In some embodiments, wherein the second target is present on the surface of a target cell, wherein the target cell is a B cell. In some embodiments, the second target is CD1a, CD1b, CD1c, CD1d, CD2, CD5, CD6, CD9, CD11a, CD11b, CD11c, CD17, CD18, CD19, CD20, CD21, CD22, CD23, CD24, CD25, CD26, CD27, CD29, CD30, CD31, CD32a, CD32b, CD35, CD37, CD38, CD39, CD40, CD45, CD45RA, CD45RB, CD45RC, CD45RO, CD46, CD47, CD48, CD49b, CD49c, CD49d, CD50, CD52, CD53, CD54, CD55, CD58, CD60a, CD62L, CD63, CD68, CD69, CD70, CD72, CD73, CD74, CD75, CD75S, CD77, CD79a, CD79b, CD80, CD81, CD82, CD83, CD84, CD85E, CD85I, CD85J, CD86, CD92, CD95, CD97, CD98, CD99, CD100, CD102, CD108, CD119, CD120a, CD120b, CD121b, CD122, CD124, CD125, CD126, CD130, CD132, CD137, CD138, CD139, CD147, CD148, CD150, CD152, CD162, CD164, CD166, CD167a, CD170, CD171, CD175, CD175s, CD180, CD184, CD185, CD192, CD196, CD197, CD200, CD205, CD201a, CDw210b, CD212, CD213a1, CD213a2, CD215, CD217, CD218a, CD218b, CD220, CD221, CD222, CD224, CD225, CD226, CD227, CD229, CD230, CD232, CD252, CD252, CD254, CD255, CD256, CD257 CD258, CD259, CD260, CD261, CD262, CD263, CD264, CD267-270, CD272, CD274, CD275, CD277, CD279, CD283, CD289, CD290, CD295, CD298, CD300, CD300c, CD305, CD306, CD307a, CD307b, CD307c, CD307d, CD307e, CD314, CD215, CD316, CD317, CD319, CD321, CD327, CD328, CD329, CD338, CD351, CD352, CD353, CD354, CD355, CD356, CD357, CD358, CD360, CD361, CD362 or CD363. In some embodiments, the second target is BCMA.

In another aspect, provided is an antibody that binds to Vα10.2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:568; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:569. In another aspect, provided is an antibody that binds to Vα10.2, comprising: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:570; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:571. In some embodiments, the VH CDR1, VH CDR2, VH CDR3, VL CDR1, VL CDR2, and VL CDR3 amino acid sequences are according to the Kabat numbering system. In some embodiments, the VH CDR1, VH CDR2, VH CDR3, VL CDR1, VL CDR2, and VL CDR3 amino acid sequences are according to the Chothia numbering system. In some embodiments, the VH CDR1, VH CDR2, VH CDR3, VL CDR1, VL CDR2, and VL CDR3 amino acid sequences are according to the AbM numbering system. In some embodiments, the VH CDR1, VH CDR2, VH CDR3, VL CDR1, VL CDR2, and VL CDR3 amino acid sequences are according to the Contact numbering system. In some embodiments, the VH CDR1, VH CDR2, VH CDR3, VL CDR1, VL CDR2, and VL CDR3 amino acid sequences are according to the IMGT numbering system. In some embodiments, the VH CDR1, VH CDR2, VH CDR3, VL CDR1, VL CDR2, and VL CDR3 amino acid sequences are according to the Exemplary numbering system. In some embodiments, the Vα10.2 antibody is a humanized antibody. In some embodiments, the Vα10.2 antibody is an IgG antibody. In some embodiments, the IgG antibody is an IgG1, IgG2, IgG3, or IgG4 antibody. In some embodiments, the IgG antibody comprises a kappa light chain. In some embodiments, the IgG antibody a lambda light chain. In some embodiments, the Vα10.2 antibody is a monoclonal antibody. In some embodiments, the Vα10.2 antibody is binds a Vα10.2 antigen. In some embodiments, the Vα10.2 antibody is binds a Vα10.2 epitope. In some embodiments, the Vα10.2 antibody specifically binds to Vα10.2. In some embodiments, the VH CDR1, VH CDR2, VH CDR3, VL CDR1, VL CDR2 and VL CDR3 form a binding site for an antigen of the Vα10.2. In some embodiments, the VH CDR1, VH CDR2, VH CDR3, VL CDR1, VL CDR2 and VL CDR3 form a binding site for an epitope of the Vα10.2. In some embodiments, the Vα10.2 is present on the surface of a T cell. In some embodiments, the Vα10.2 antibody is multivalent. In some embodiments, the Vα10.2 antibody is a multispecific antibody. In some embodiments, the Vα10.2 antibody is a bispecific antibody. In some embodiments, the multispecific Vα10.2 antibody further binds to a second target, wherein the second target is BCMA.

In yet other aspects, provided herein is an antibody that binds Vβ17, comprising: (i) a VH comprising a VH CDR1 having an amino acid sequence of SEQ ID NO:48, a VH CDR2 having an amino acid sequence of SEQ ID NO:49, and a VH CDR3 having an amino acid sequence of SEQ ID NO:50; and (ii) a VL comprising a VL CDR1 having an amino acid sequence of SEQ ID NO:51, a VL CDR2 having an amino acid sequence of SEQ ID NO:52, and a VL CDR3 having an amino acid sequence of SEQ ID NO:53. In some embodiments, the antibody comprises a VH having an amino acid sequence of SEQ ID NO:77. In some embodiments, the antibody comprises a VL having an amino acid sequence of SEQ ID NO:78. In some embodiments, the antibody comprises a VH having an amino acid sequence of SEQ ID NO:77, and a VL having an amino acid sequence of SEQ ID NO:78. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In certain embodiments, the T cell is an T cell. In some embodiments, the T cell is a CD8+ T cell. In some embodiments, the T cell is a CD4+ T cell. In some embodiments, the T cell is a cytotoxic T lymphocyte (CTL). In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In one aspect, provided herein is an antibody that binds Vβ17, comprising: (i) a VH comprising a VH CDR1 having an amino acid sequence of SEQ ID NO:48, a VH CDR2 having an amino acid sequence of SEQ ID NO:54, and a VH CDR3 having an amino acid sequence of SEQ ID NO:55; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:58. In some embodiments, the antibody comprises a VH having an amino acid sequence of SEQ ID NO:79. In some embodiments, the antibody comprises a VL having an amino acid sequence of SEQ ID NO:80. In some embodiments, the antibody comprises a VH having an amino acid sequence of SEQ ID NO:79, and a VL having an amino acid sequence of SEQ ID NO:80. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In another aspect, provided herein is an antibody that binds Vβ17, comprising: (i) a VH comprising a VH CDR1 having an amino acid sequence of SEQ ID NO:59, a VH CDR2 having an amino acid sequence of SEQ ID NO:49, and a VH CDR3 having an amino acid sequence of SEQ ID NO:60; and (ii) a VL comprising a VL CDR1 having an amino acid sequence of SEQ ID NO:61, a VL CDR2 having an amino acid sequence of SEQ ID NO:62, and a VL CDR3 having an amino acid sequence of SEQ ID NO:63. In some embodiments, the antibody comprises a VH having an amino acid sequence of SEQ ID NO:81. In some embodiments, the antibody comprises a VL having an amino acid sequence of SEQ ID NO:82. In some embodiments, the antibody comprises a VH having an amino acid sequence of SEQ ID NO:81, and a VL having an amino acid sequence of SEQ ID NO:82. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In another aspect, provided herein is an antibody that binds Vβ17, comprising: (i) a VH comprising a VH CDR1 having an amino acid sequence of SEQ ID NO:64, a VH CDR2 having an amino acid sequence of SEQ ID NO:65, and a VH CDR3 having an amino acid sequence of SEQ ID NO:66; and (ii) a VL comprising a VL CDR1 having an amino acid sequence of SEQ ID NO:67, a VL CDR2 having an amino acid sequence of SEQ ID NO:68, and a VL CDR3 having an amino acid sequence of SEQ ID NO:69. In some embodiments, the antibody comprises a VH having an amino acid sequence of SEQ ID NO:83. In some embodiments, the antibody comprises a VL having an amino acid sequence of SEQ ID NO:84. In some embodiments, the antibody comprises a VH having an amino acid sequence of SEQ ID NO:83, and a VL having an amino acid sequence of SEQ ID NO:84. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In one aspect, provided herein is an antibody that binds Vβ17, comprising: (i) a VH comprising a VH CDR1 having an amino acid sequence of SEQ ID NO:70, a VH CDR2 having an amino acid sequence of SEQ ID NO:49, and a VH CDR3 having an amino acid sequence of SEQ ID NO:71; and (ii) a VL comprising a VL CDR1 having an amino acid sequence of SEQ ID NO:61, a VL CDR2 having an amino acid sequence of SEQ ID NO:72, and a VL CDR3 having an amino acid sequence of SEQ ID NO:73. In some embodiments, the antibody comprises a VH having an amino acid sequence of SEQ ID NO:85. In some embodiments, the antibody comprises a VL having an amino acid sequence of SEQ ID NO:86. In some embodiments, the antibody comprises a VH having an amino acid sequence of SEQ ID NO:85, and a VL having an amino acid sequence of SEQ ID NO:86. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In one aspect, provided herein is an antibody that binds Vβ17, comprising: (i) a VH comprising a VH CDR1 having an amino acid sequence of SEQ ID NO:48, a VH CDR2 having an amino acid sequence of SEQ ID NO:74, and a VH CDR3 having an amino acid sequence of SEQ ID NO:75; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:76. In some embodiments, the antibody comprises a VH having an amino acid sequence of SEQ ID NO:87. In some embodiments, the antibody comprises a VL having an amino acid sequence of SEQ ID NO:88. In some embodiments, the antibody comprises a VH having an amino acid sequence of SEQ ID NO:87, and a VL having an amino acid sequence of SEQ ID NO:88. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In one aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:664, a VL CDR2 having an amino acid sequence of SEQ ID NO:5, and a VL CDR3 having an amino acid sequence of SEQ ID NO:6. In some embodiments, the antibody comprises a VH having an amino acid sequence of SEQ ID NO:21. In some embodiments, the antibody comprises a VL having an amino acid sequence of SEQ ID NO:665. In some embodiments, the antibody comprises a VH having an amino acid sequence of SEQ ID NO:21, and a VL having an amino acid sequence of SEQ ID NO:665. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In one aspect, provided herein is an antibody that binds Vβ17, comprising: (i) a VH comprising a VH CDR1 having an amino acid sequence of SEQ ID NO:979, a VH CDR2 having an amino acid sequence of SEQ ID NO:980, and a VH CDR3 having an amino acid sequence of SEQ ID NO:981; and (ii) a VL comprising a VL CDR1 having an amino acid sequence of SEQ ID NO:994, a VL CDR2 having an amino acid sequence of SEQ ID NO:995, and a VL CDR3 having an amino acid sequence of SEQ ID NO:996. In some embodiments, the antibody comprises a VH having an amino acid sequence of SEQ ID NO:1000. In some embodiments, the antibody comprises a VL having an amino acid sequence of SEQ ID NO:1001. In some embodiments, the antibody comprises a VH having an amino acid sequence of SEQ ID NO:1000, and a VL having an amino acid sequence of SEQ ID NO:1001. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In one aspect, provided herein is an antibody that binds Vβ17, comprising: (i) a VH comprising a VH CDR1 having an amino acid sequence of SEQ ID NO:1011, a VH CDR2 having an amino acid sequence of SEQ ID NO:1012, and a VH CDR3 having an amino acid sequence of SEQ ID NO:1013; and (ii) a VL comprising a VL CDR1 having an amino acid sequence of SEQ ID NO:1026, a VL CDR2 having an amino acid sequence of SEQ ID NO:1027, and a VL CDR3 having an amino acid sequence of SEQ ID NO:1028. In some embodiments, the antibody comprises a VH having an amino acid sequence of SEQ ID NO:1032. In some embodiments, the antibody comprises a VL having an amino acid sequence of SEQ ID NO:1033. In some embodiments, the antibody comprises a VH having an amino acid sequence of SEQ ID NO:1032, and a VL having an amino acid sequence of SEQ ID NO:1033. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In one aspect, provided herein is an antibody that binds Vβ17, comprising: (i) a VH comprising a VH CDR1 having an amino acid sequence of SEQ ID NO:1043, a VH CDR2 having an amino acid sequence of SEQ ID NO:1044, and a VH CDR3 having an amino acid sequence of SEQ ID NO:1045; and (ii) a VL comprising a VL CDR1 having an amino acid sequence of SEQ ID NO:1058, a VL CDR2 having an amino acid sequence of SEQ ID NO:1059, and a VL CDR3 having an amino acid sequence of SEQ ID NO:1060. In some embodiments, the antibody comprises a VH having an amino acid sequence of SEQ ID NO:1064. In some embodiments, the antibody comprises a VL having an amino acid sequence of SEQ ID NO:1065. In some embodiments, the antibody comprises a VH having an amino acid sequence of SEQ ID NO:1064, and a VL having an amino acid sequence of SEQ ID NO:165. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In one aspect, provided herein is an antibody that binds Vβ17, comprising: (i) a VH comprising a VH CDR1 having an amino acid sequence of SEQ ID NO:1075, a VH CDR2 having an amino acid sequence of SEQ ID NO:1076, and a VH CDR3 having an amino acid sequence of SEQ ID NO:1077; and (ii) a VL comprising a VL CDR1 having an amino acid sequence of SEQ ID NO:1090, a VL CDR2 having an amino acid sequence of SEQ ID NO:1091, and a VL CDR3 having an amino acid sequence of SEQ ID NO:1092. In some embodiments, the antibody comprises a VH having an amino acid sequence of SEQ ID NO:1096. In some embodiments, the antibody comprises a VL having an amino acid sequence of SEQ ID NO:1097. In some embodiments, the antibody comprises a VH having an amino acid sequence of SEQ ID NO:1096, and a VL having an amino acid sequence of SEQ ID NO:197. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In one aspect, provided herein is an antibody that binds Vβ17, comprising: (i) a VH comprising a VH CDR1 having an amino acid sequence of SEQ ID NO:1107, a VH CDR2 having an amino acid sequence of SEQ ID NO:1108, and a VH CDR3 having an amino acid sequence of SEQ ID NO:1109; and (ii) a VL comprising a VL CDR1 having an amino acid sequence of SEQ ID NO:1122, a VL CDR2 having an amino acid sequence of SEQ ID NO:1123, and a VL CDR3 having an amino acid sequence of SEQ ID NO:1124. In some embodiments, the antibody comprises a VH having an amino acid sequence of SEQ ID NO:1128. In some embodiments, the antibody comprises a VL having an amino acid sequence of SEQ ID NO:1129. In some embodiments, the antibody comprises a VH having an amino acid sequence of SEQ ID NO:1128, and a VL having an amino acid sequence of SEQ ID NO:1129. In some embodiments, the antibody comprises a humanized antibody. In some embodiments, the antibody comprises an IgG antibody. In some embodiments, the antibody comprises an IgG1, IgG2, IgG3, or IgG4 antibody. In some embodiments, the antibody binds a Vβ17 antigen. In some embodiments, the antibody binds a Vβ17 epitope. In some embodiments, the VH CDR1, VH CDR2, VH CDR3, VL CDR1, VL CDR2 and VL CDR3 of the antibody forms a binding site for an antigen of the Vβ17. In some embodiments, the VH CDR1, VH CDR2, VH CDR3, VL CDR1, VL CDR2 and VL CDR3 of the antibody form a binding site for an epitope of the Vβ17. In some embodiments, the antibody comprises a Vβ17 that is present on the surface of a T cell. In some embodiments, the antibody comprises a bispecific antibody that is multivalent. In some embodiments, the antibody is capable of binding at least three antigens. In some embodiments, the bispecific antibody is capable of binding at least five antigens. In some embodiments, the antibody is a multispecific antibody.

In another aspect, provided herein is a bispecific antibody comprising: (a) a first binding domain that binds to Vβ17, and (b) a second binding domain that binds to a second target that is not Vβ17.

In some embodiments, the first binding domain of the bispecific antibody comprises (i) a VH comprising a VH CDR1 having an amino acid sequence of SEQ ID NO:48, a VH CDR2 having an amino acid sequence of SEQ ID NO:49, and a VH CDR3 having an amino acid sequence of SEQ ID NO:50; and (ii) a VL comprising a VL CDR1 having an amino acid sequence of SEQ ID NO:51, a VL CDR2 having an amino acid sequence of SEQ ID NO:52, and a VL CDR3 having an amino acid sequence of SEQ ID NO:53. In some embodiments, the bispecific antibody comprises a VH having an amino acid sequence of SEQ ID NO:77. In some embodiments, the bispecific antibody comprises a VL having an amino acid sequence of SEQ ID NO:78. In some embodiments, the bispecific antibody comprises a VH having an amino acid sequence of SEQ ID NO:77, and a VL having an amino acid sequence of SEQ ID NO:78. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises: (i) a VH comprising a VH CDR1 having an amino acid sequence of SEQ ID NO:48, a VH CDR2 having an amino acid sequence of SEQ ID NO:54, and a VH CDR3 having an amino acid sequence of SEQ ID NO:55; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:58. In some embodiments, the bispecific antibody comprises a VH having an amino acid sequence of SEQ ID NO:79. In some embodiments, the bispecific antibody comprises a VL having an amino acid sequence of SEQ ID NO:80. In some embodiments, the bispecific antibody comprises a VH having an amino acid sequence of SEQ ID NO:79, and a VL having an amino acid sequence of SEQ ID NO:80. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises (i) a VH comprising a VH CDR1 having an amino acid sequence of SEQ ID NO:59, a VH CDR2 having an amino acid sequence of SEQ ID NO:49, and a VH CDR3 having an amino acid sequence of SEQ ID NO:60; and (ii) a VL comprising a VL CDR1 having an amino acid sequence of SEQ ID NO:61, a VL CDR2 having an amino acid sequence of SEQ ID NO:62, and a VL CDR3 having an amino acid sequence of SEQ ID NO:63. In some embodiments, the bispecific antibody comprises a VH having an amino acid sequence of SEQ ID NO:81. In some embodiments, the bispecific antibody comprises a VL having an amino acid sequence of SEQ ID NO:82. In some embodiments, the bispecific antibody comprises a VH having an amino acid sequence of SEQ ID NO:81, and a VL having an amino acid sequence of SEQ ID NO:82. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises: (i) a VH comprising a VH CDR1 having an amino acid sequence of SEQ ID NO:64, a VH CDR2 having an amino acid sequence of SEQ ID NO:65, and a VH CDR3 having an amino acid sequence of SEQ ID NO:66; and (ii) a VL comprising a VL CDR1 having an amino acid sequence of SEQ ID NO:67, a VL CDR2 having an amino acid sequence of SEQ ID NO:68, and a VL CDR3 having an amino acid sequence of SEQ ID NO:69. In some embodiments, the bispecific antibody comprises a VH having an amino acid sequence of SEQ ID NO:83. In some embodiments, the bispecific antibody comprises a VL having an amino acid sequence of SEQ ID NO:84. In some embodiments, the bispecific antibody comprises a VH having an amino acid sequence of SEQ ID NO:83, and a VL having an amino acid sequence of SEQ ID NO:84. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises: (i) a VH comprising a VH CDR1 having an amino acid sequence of SEQ ID NO:70, a VH CDR2 having an amino acid sequence of SEQ ID NO:49, and a VH CDR3 having an amino acid sequence of SEQ ID NO:71; and (ii) a VL comprising a VL CDR1 having an amino acid sequence of SEQ ID NO:61, a VL CDR2 having an amino acid sequence of SEQ ID NO:72, and a VL CDR3 having an amino acid sequence of SEQ ID NO:73. In some embodiments, the bispecific antibody comprises a VH having an amino acid sequence of SEQ ID NO:85. In some embodiments, the bispecific antibody comprises a VL having an amino acid sequence of SEQ ID NO:86. In some embodiments, the bispecific antibody comprises a VH having an amino acid sequence of SEQ ID NO:85, and a VL having an amino acid sequence of SEQ ID NO:86. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises: (i) a VH comprising a VH CDR1 having an amino acid sequence of SEQ ID NO:48, a VH CDR2 having an amino acid sequence of SEQ ID NO:74, and a VH CDR3 having an amino acid sequence of SEQ ID NO:75; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:76. In some embodiments, the bispecific antibody comprises a VH having an amino acid sequence of SEQ ID NO:87. In some embodiments, the bispecific antibody comprises a VL having an amino acid sequence of SEQ ID NO:88. In some embodiments, the bispecific antibody comprises a VH having an amino acid sequence of SEQ ID NO:87, and a VL having an amino acid sequence of SEQ ID NO:88. In some embodiments, the first binding domain of the bispecific antibody comprises: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:664, a VL CDR2 having an amino acid sequence of SEQ ID NO:5, and a VL CDR3 having an amino acid sequence of SEQ ID NO:6. In some embodiments, the bispecific antibody comprises a VH having an amino acid sequence of SEQ ID NO:21. In some embodiments, the bispecific antibody comprises a VL having an amino acid sequence of SEQ ID NO:677. In some embodiments, the bispecific antibody comprises a VH having an amino acid sequence of SEQ ID NO:21, and a VL having an amino acid sequence of SEQ ID NO:677. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises: (i) a VH comprising a VH CDR1 having an amino acid sequence of SEQ ID NO 979, a VH CDR2 having an amino acid sequence of SEQ ID NO:980, and a VH CDR3 having an amino acid sequence of SEQ ID NO:981; and (ii) a VL comprising a VL CDR1 having an amino acid sequence of SEQ ID NO:994, a VL CDR2 having an amino acid sequence of SEQ ID NO:995, and a VL CDR3 having an amino acid sequence of SEQ ID NO:996. In some embodiments, the bispecific antibody comprises a VH having an amino acid sequence of SEQ ID NO:1000. In some embodiments, the bispecific antibody comprises a VL having an amino acid sequence of SEQ ID NO:1001. In some embodiments, the bispecific antibody comprises a VH having an amino acid sequence of SEQ ID NO:1000, and a VL having an amino acid sequence of SEQ ID NO:1001. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises: (i) a VH comprising a VH CDR1 having an amino acid sequence of SEQ ID NO:1011, a VH CDR2 having an amino acid sequence of SEQ ID NO:1012, and a VH CDR3 having an amino acid sequence of SEQ ID NO:1013; and (ii) a VL comprising a VL CDR1 having an amino acid sequence of SEQ ID NO:1026, a VL CDR2 having an amino acid sequence of SEQ ID NO:1027, and a VL CDR3 having an amino acid sequence of SEQ ID NO:1028. In some embodiments, the bispecific antibody comprises a VH having an amino acid sequence of SEQ ID NO:1032. In some embodiments, the bispecific antibody comprises a VL having an amino acid sequence of SEQ ID NO:1033. In some embodiments, the bispecific antibody comprises a VH having an amino acid sequence of SEQ ID NO:1032, and a VL having an amino acid sequence of SEQ ID NO:1033. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises: (i) a VH comprising a VH CDR1 having an amino acid sequence of SEQ ID NO:1043, a VH CDR2 having an amino acid sequence of SEQ ID NO:1044, and a VH CDR3 having an amino acid sequence of SEQ ID NO:1045; and (ii) a VL comprising a VL CDR1 having an amino acid sequence of SEQ ID NO:1058, a VL CDR2 having an amino acid sequence of SEQ ID NO:1059, and a VL CDR3 having an amino acid sequence of SEQ ID NO:1060. In some embodiments, the bispecific antibody comprises a VH having an amino acid sequence of SEQ ID NO:1064. In some embodiments, the bispecific antibody comprises a VL having an amino acid sequence of SEQ ID NO:1065. In some embodiments, the bispecific antibody comprises a VH having an amino acid sequence of SEQ ID NO:1064, and a VL having an amino acid sequence of SEQ ID NO:1065. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises: (i) a VH comprising a VH CDR1 having an amino acid sequence of SEQ ID NO:1075, a VH CDR2 having an amino acid sequence of SEQ ID NO:1076, and a VH CDR3 having an amino acid sequence of SEQ ID NO:1077; and (ii) a VL comprising a VL CDR1 having an amino acid sequence of SEQ ID NO:1090, a VL CDR2 having an amino acid sequence of SEQ ID NO:1091, and a VL CDR3 having an amino acid sequence of SEQ ID NO:1092. In some embodiments, the bispecific antibody comprises a VH having an amino acid sequence of SEQ ID NO:1096. In some embodiments, the bispecific antibody comprises a VL having an amino acid sequence of SEQ ID NO:1097. In some embodiments, the bispecific antibody comprises a VH having an amino acid sequence of SEQ ID NO:1096, and a VL having an amino acid sequence of SEQ ID NO:1097. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the first binding domain of the bispecific antibody comprises: (i) a VH comprising a VH CDR1 having an amino acid sequence of SEQ ID NO:1107, a VH CDR2 having an amino acid sequence of SEQ ID NO:1108, and a VH CDR3 having an amino acid sequence of SEQ ID NO:1109; and (ii) a VL comprising a VL CDR1 having an amino acid sequence of SEQ ID NO:1122, a VL CDR2 having an amino acid sequence of SEQ ID NO:1123, and a VL CDR3 having an amino acid sequence of SEQ ID NO:1124. In some embodiments, the bispecific antibody comprises a VH having an amino acid sequence of SEQ ID NO:1128. In some embodiments, the bispecific antibody comprises a VL having an amino acid sequence of SEQ ID NO:1129. In some embodiments, the bispecific antibody comprises a VH having an amino acid sequence of SEQ ID NO:1128, and a VL having an amino acid sequence of SEQ ID NO:1129. In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3,
VL CDR1, VL CDR2 and VL CDR3 of the bispecific antibody form a binding site for an epitope of the second target. In some embodiments, the second target of the bispecific antibody is on the surface of a second cell.

In some embodiments, the Vβ17 of the bispecific antibody is present on the surface of a T cell. In some embodiments, the first binding domain of the bispecific antibody is humanized, the second binding domain is humanized, or both the first binding domain and the second binding domain are humanized. In some embodiments, the bispecific antibody comprises an IgG antibody. In some embodiments, the bispecific antibody comprises an IgG1, IgG2, IgG3, or IgG4 antibody. In some embodiments, the first binding domain of the bispecific antibody binds a Vβ17 antigen. In some embodiments, the first binding domain of the bispecific antibody binds a Vβ17 epitope. In some embodiments, the VH CDR1, VH CDR2, VH CDR3, VL CDR1, VL CDR2 and VL CDR3 of the bispecific antibody form a binding site for an antigen of the Vβ17. In some embodiments, the VH CDR1, VH CDR2, VH CDR3, VL CDR1, VL CDR2 and VL CDR3 of the bispecific antibody form a binding site for an epitope of the Vβ17. In some embodiments, the second binding domain of the bispecific antibody binds an antigen of the second target. In some embodiments, the second binding domain of the bispecific antibody binds an epitope of the second target. In some embodiments, the VH CDR1, VH CDR2, VH CDR3, VL CDR1, VL CDR2 and VL CDR3 of the bispecific antibody form a binding site for an antigen of the second target. In some embodiments, the VH CDR1, VH CDR2, VH CDR3, VL CDR1, VL CDR2 and VL CDR3 of the bispecific antibody form a binding site for an epitope of the second target. In some embodiments, the second target of the bispecific antibody is on the surface of a second cell.

In some embodiments, the second cell is a cancer cell. In some embodiments, the second target is a tumor-specific antigen, a tumor associated antigen, or a neoantigen.

In some embodiments, the cancer is an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer. In some embodiments, the adrenal cancer is an adrenocortical carcinoma (ACC), adrenal cortex cancer, pheochromocytoma, or neuroblastoma. In some embodiments, the anal cancer is a squamous cell carcinoma, cloacogenic carcinoma, adenocarcinoma, basal cell carcinoma, or melanoma. In some embodiments, the appendix cancer is a neuroendocrine tumor (NET), mucinous adenocarcinoma, goblet cell carcinoid, intestinal-type adenocarcinoma, or signet-ring cell adenocarcinoma. In some embodiments, the bile duct cancer is an extrahepatic bile duct cancer, adenocarcinomas, hilar bile duct cancer, perihilar bile duct cancer, distal bile duct cancer, or intrahepatic bile duct cancer. In some embodiments, the bladder cancer is transitional cell carcinoma (TCC), papillary carcinoma, flat carcinoma, squamous cell carcinoma, adenocarcinoma, small-cell carcinoma, or sarcoma. In some embodiments, the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer. In some embodiments, the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma. In some embodiments, the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer. In some embodiments, the cervical cancer is a squamous cell carcinoma, or adenocarcinoma.

In some embodiments, the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma. In some embodiments, the esophageal cancer is an adenocarcinoma or squamous cell carcinoma. In some embodiments, the gall bladder cancer is an adenocarcinoma, papillary adenocarcinoma, adenosquamous carcinoma, squamous cell carcinoma, small cell carcinoma, or sarcoma. In some embodiments, the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT). In some embodiments, the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer. In some embodiments, the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL). In some embodiments, the intestinal cancer is a small intestine cancer, small bowel cancer, adenocarcinoma, sarcoma, gastrointestinal stromal tumors, carcinoid tumors, or lymphoma. In some embodiments, the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma. In some embodiments, the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS). In some embodiments, the liver cancer is a hepatocellular carcinoma (HCC), fibrolamellar HCC, cholangiocarcinoma, angiosarcoma, or liver metastasis. In some embodiments, the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor. In some embodiments, the melanoma is a superficial spreading melanoma, nodular melanoma, acral-lentiginous melanoma, lentigo maligna melanoma, amelanotic melanoma, desmoplastic melanoma, ocular melanoma, or metastatic melanoma. In some embodiments, the mesothelioma is a pleural mesothelioma, peritoneal mesothelioma, pericardial mesothelioma, or testicular mesothelioma. In some embodiments, the multiple myeloma is an active myeloma or smoldering myeloma. In some embodiments, the neuroendocrine tumor, is a gastrointestinal neuroendocrine tumor, pancreatic neuroendocrine tumor, or lung neuroendocrine tumor. In some embodiments, the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma. In some embodiments, the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma acuminatum, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer. In some embodiments, the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst. In some embodiments, the pancreatic cancer is a pancreatic exocrine gland cancer, pancreatic endocrine gland cancer, or pancreatic adenocarcinoma, islet cell tumor, or neuroendocrine tumor. In some embodiments, the prostate cancer is a prostate adenocarcinoma, prostate sarcoma, transitional cell carcinoma, small cell carcinoma, or neuroendocrine tumor. In some embodiments, the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer. In some embodiments, the skin cancer is a basal cell carcinoma, squamous cell carcinoma, melanoma, Merkel cell carcinoma, Kaposi sarcoma (KS), actinic keratosis, skin lymphoma, or keratoacanthoma. In some embodiments, the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma. In some embodiments, the spinal cancer is a spinal metastatic tumor. In some embodiments, the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid. In some embodiments, the testicular cancer is a seminoma, non-seminoma, embryonal carcinoma, yolk sac carcinoma, choriocarcinoma, teratoma, gonadal stromal tumor, leydig cell tumor, or sertoli cell tumor. In some embodiments, the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer. In some embodiments, the thyroid cancer is a papillary carcinoma, follicular carcinoma, Hürthle cell carcinoma, medullary thyroid carcinoma, or anaplastic carcinoma. In some embodiments, the uterine cancer is an endometrial cancer, endometrial adenocarcinoma, endometroid carcinoma, serous adenocarcinoma, adenosquamous carcinoma, uterine carcinosarcoma, uterine sarcoma, uterine leiomyosarcoma, endometrial stromal sarcoma, or undifferentiated sarcoma. In some embodiments, the vaginal cancer is a squamous cell carcinoma, adenocarcinoma, melanoma, or sarcoma. In some embodiments, the vulvar cancer is a squamous cell carcinoma or adenocarcinoma.

In some embodiments, the second target is angiopoietin, BCMA, CD19, CD20, CD22, CD25 (IL2-R), CD30, CD33, CD37, CD38, CD52, CD56, CD123 (IL-3R), cMET, DLL/Notch, EGFR, EpCAM, FGF, FGF-R, GD2, HER2, Mesothelin, Nectin-4, PDGFRα, RANKL, SLAMF7, TROP2, VEGF, VEGF-R, CEA, immature laminin receptor, TAG-72, HPV E6, HPV E7, BING-4, calcium-activated chloride channel 2, cyclin-B1, 9D7, EpCAM, EphA3, Her2/neu, telomerase, mesothelin, SAP-1, surviving, a BAGE family antigen, a CAGE family antigen, a GAGE family antigen, a MAGE family antigen, a SAGE family antigen, a XAGE family antigen, NY-ESO-1/LAGE-1, PRAME, SSX-2, Melan-A, MART-1, Gp100, pmel17, tyrosinase, TRP-1, TRP-2, P. polypeptide, MC1R, prostate-specific antigen, β-catenin, BRCA1, BRCA2, CDK4, CML66, fibronectin, MART-2, p53, Ras, TGF-βRII, or MUC1.

In some embodiments, the second target of the bispecific antibody is CD123. In some embodiments, the second binding domain of the bispecific antibody comprises: (i) a VH comprising a VH CDR1 having an amino acid sequence of SEQ ID NO:34, a VH CDR2 having an amino acid sequence of SEQ ID NO:35, and a VH CDR3 having an amino acid sequence of SEQ ID NO:36; and (ii) a VL comprising a VL CDR1 having an amino acid sequence of SEQ ID NO:37, a VL CDR2 having an amino acid sequence of SEQ ID NO:38, and a VL CDR3 having an amino acid sequence of SEQ ID NO:39.

In some embodiments, the second target of the bispecific antibody is BCMA. In some embodiments, the second binding domain of the bispecific antibody comprises: (i) a VH comprising a VH CDR1 having an amino acid sequence of SEQ ID NO:89, a VH CDR2 having an amino acid sequence of SEQ ID NO:90, and a VH CDR3 having an amino acid sequence of SEQ ID NO:91; and (ii) a VL comprising a VL CDR1 having an amino acid sequence of SEQ ID NO:93, a VL CDR2 having an amino acid sequence of SEQ ID NO:94, and a VL CDR3 having an amino acid sequence of SEQ ID NO:94.

In some embodiments, the second cell is a B cell. In some embodiments, second target is CD1a, CD1b, CD1c, CD1d, CD2, CD5, CD6, CD9, CD11a, CD11b, CD11c, CD17, CD18, CD19, CD20, CD21, CD22, CD23, CD24, CD25, CD26, CD27, CD29, CD30, CD31, CD32a, CD32b, CD35, CD37, CD38, CD39, CD40, CD45, CD45RA, CD45RB, CD45RC, CD45RO, CD46, CD47, CD48, CD49b, CD49c, CD49d, CD50, CD52, CD53, CD54, CD55, CD58, CD60a, CD62L, CD63, CD68, CD69, CD70, CD72, CD73, CD74, CD75, CD75S, CD77, CD79a, CD79b, CD80, CD81, CD82, CD83, CD84, CD85E, CD85I, CD85J, CD86, CD92, CD95, CD97, CD98, CD99, CD100, CD102, CD108, CD119, CD120a, CD120b, CD121b, CD122, CD124, CD125, CD126, CD130, CD132, CD137, CD138, CD139, CD147, CD148, CD150, CD152, CD162, CD164, CD166, CD167a, CD170, CD171, CD175, CD175s, CD180, CD184, CD185, CD192, CD196, CD197, CD200, CD205, CD201a, CDw210b, CD212, CD213a1, CD213a2, CD215, CD217, CD218a, CD218b, CD220, CD221, CD222, CD224, CD225, CD226, CD227, CD229, CD230, CD232, CD252, CD252, CD254, CD255, CD256, CD257 CD258, CD259, CD260, CD261, CD262, CD263, CD264, CD267, CD268, CD269, CD270, CD272, CD274, CD275, CD277, CD279, CD283, CD289, CD290, CD295, CD298, CD300, CD300c, CD305, CD306, CD307a, CD307b, CD307c, CD307d, CD307e, CD314, CD215, CD316, CD317, CD319, CD321, CD327, CD328, CD329, CD338, CD351, CD352, CD353, CD354, CD355, CD356, CD357, CD358, CD360, CD361, CD362, or CD363.

In some embodiments, the second cell is killed when the bispecific antibody binds to the Vβ17 on the surface of the T cell and the second target on the surface of the second cell.

In some embodiments, the bispecific antibody induces T cell dependent cytotoxicity of the second cell in vitro with an $EC_{50}$ of less than about 500 μM. In some embodiments, the bispecific antibody induces T cell dependent cytotoxicity of the second cell in vitro with an $EC_{50}$ of less than about 300 μM. In some embodiments, the bispecific antibody induces T cell dependent cytotoxicity of the second cell in vitro with an $EC_{50}$ of less than about 160 μM.

In some embodiments, the $EC_{50}$ is assessed with a mixture of αβ T effector cells and target cells expressing the second target. In some embodiments, the effector cell to target cell ratio is about 0.01 to 1 to about 10 to 1. In some embodiments, the effector cell to target cell ratio is about 0.1 to 1 to about 5 to 1. In some embodiments, the effector cell to target cell ratio is about 1:1.

In some embodiments, the bispecific antibody is multivalent. In some embodiments, the bispecific antibody is capable of binding at least three antigens. In some embodiments, the bispecific antibody is capable of binding at least five antigens.

In one aspect, provided herein is a bispecific antibody comprising: a first means capable of binding Vβ17 on the surface of the T cell; and a second means capable of binding a second target that is not Vβ17. In some embodiments, the second target of the bispecific antibody is on the surface of a second cell.

In one aspect, provided herein is a nucleic acid encoding the antibody of any one of the previous embodiments or the bispecific antibody of any one of the previous embodiments. Also provided herein is a vector comprising the nucleic acid. In one aspect, provided herein is a host cell comprising the vector. Also provided is a kit comprising the vector and packaging for the same. In some aspects, the packaging comprises a compartment for holding the vector.

In one aspect, provided herein is a pharmaceutical composition comprising antibody of any one of the previous embodiments or the bispecific antibody of any the previous embodiments, and a pharmaceutically acceptable carrier. Also provided is a method of producing the pharmaceutical composition, comprising combining the antibody with a pharmaceutically acceptable carrier to obtain the pharmaceutical composition.

In one aspect, provided herein is a method of directing a T cell expressing Vβ17 to a second target, the method comprising contacting the T cell with the bispecific antibody of any one of the previous embodiments. In some aspects the contacting directs the T cell to the second target.

In one aspect, provided herein is a method of inhibiting growth or proliferation of target cells expressing the second target on the cell surface, the method comprising contacting the target cells with the bispecific antibody of any one of the previous embodiments. In some aspects contacting the target cells with the pharmaceutical composition inhibits growth or proliferation of the target cells. In some aspects contacting the target cells with the antibody or the bispecific antibody inhibits growth or proliferation of the target cells.

In some embodiments, the target cells are in the presence of a T cell expressing Vβ17 while in contact with the bispecific antibody.

In one aspect, provided herein is a method for eliminating target cells expressing the second target in a subject, comprising administering an effective amount of the bispecific antibody of any one the previous embodiments to the subject. In some embodiments of the method, the subject has a cancer. In some embodiments of the method, the subject has a leukemia. In some embodiments of the method, the subject has a lymphoma.

In one aspect, provided herein is a method of treating a disease caused all or in part by target cells expressing the second target in a subject, comprising administering an effective amount of the bispecific antibody of any one of the previous embodiments to the subject. In some embodiments of the method, the disease is cancer. In some embodiments of the method, the disease is a leukemia. In some embodiments of the method, the disease is a lymphoma.

In some embodiments of the method, the subject is a subject in need thereof. In some embodiments of the method, the subject is a human.

In one aspect, provided herein is a method of activating a T cell expressing Vβ17, comprising contacting the T cell with the bispecific antibody of any one of the previous embodiments. In some embodiments of the method, the contacting results in an increase in CD69, CD25, and/or Granzyme B expression, as compared to a control T cell expressing Vβ17. In one aspect, a control T cell is a comparable T cell expressing Vβ17. In one aspect, the comparable T cell (e.g., control T cell) is not contacted with the bispecific antibody.

In another aspect, provided herein is a process for making an antibody that binds to more than one target molecule, the process comprising: a step for performing a function of obtaining a binding domain capable of binding to Vβ17 on an T cell; a step for performing a function of obtaining a binding domain capable of binding to a second target on a second cell; and a step for performing a function of providing an antibody capable of binding to a Vβ17 (e.g., Vβ17 antigen) on a T cell and a second target on a second cell. In some embodiments of the process, the step for performing a function of obtaining a binding domain capable of binding to a second target is repeated n times and further comprising n steps for performing a function of providing a binding domain capable of binding to a Vβ17 on a T cell and n number of target molecules, wherein n is at least 2. In some embodiments of the process, the second target is on the surface of the second cell. In some embodiments of the process, the second cell is a cancer cell. In some embodiments, the second target is a tumor-specific antigen, a tumor associated antigen, or a neoantigen. In some embodiments of the process, the second cell is a B cell. In some embodiments of the process, the second target is CD123. In some embodiments of the process, the second target is BCMA. Other exemplary second targets are provided herein and contemplated as embodiments of the process. In some embodiments of the process, the binding domain capable of binding to Vβ17 binds a Vβ17 antigen. In some embodiments of the process, the binding domain capable of binding to Vβ17 binds a Vβ17 epitope. In some embodiments of the process, the binding domain capable of binding to a second target binds an antigen of the second target. In some embodiments of the process, the binding domain capable of binding to a second target binds an epitope of the second target.

In another aspect, provided herein is a bispecific antibody comprising: a first means capable of binding Vβ17 on the surface of the T cell; and a second means capable of binding a second target on the surface of a second cell. In some embodiments, the second cell is a cancer cell. In some embodiments, the second target is a tumor-specific antigen, a tumor associated antigen, or a neoantigen. In some embodiments of the bispecific antibody, the second cell is a B cell. In some embodiments of the bispecific antibody, the second target is CD123. In some embodiments of the bispecific antibody, the second target is BCMA. In some embodiments of the bispecific antibody, the second target is DLL3. In some embodiments of the bispecific antibody, the second target is PSMA. In some embodiments of the bispecific antibody, the second target is KLK2. Other exemplary second targets are provided herein and contemplated as embodiments of the process.

In some embodiments, the first means of the bispecific antibody is capable of binding Vβ17 binds a Vβ17 antigen. In some embodiments, the first means of the bispecific antibody is capable of binding Vβ17 binds a Vβ17 epitope. In some embodiments, the first means of the bispecific antibody is capable of binding to a second target binds an antigen of the second target. In some embodiments, the first means of the bispecific antibody is capable of binding to a second target binds an epitope of the second target. In some embodiments, the second means of the bispecific antibody is capable of binding to a second target binds an antigen of the second target. In some embodiments, the second means of the bispecific antibody is capable of binding to a second target binds an epitope of the second target.

Also provided are kits comprising bispecific antibodies or antigen-binding fragments thereof disclosed herein and packaging for the same.

BRIEF DESCRIPTION OF THE DRAWINGS

The foregoing summary, as well as the following detailed description of specific embodiments of the present application, will be better understood when read in conjunction with the appended drawings. It should be understood, however, that the application is not limited to the precise embodiments shown in the drawings.

FIG. 2A shows FACS histograms of gated peripheral blood mononuclear cells (PBMCs) for CD8+ T cells expressing Vβ17 (Vβ17+) on the cells surface from healthy subjects. FIG. 2B shows HLA sub-type of various donors and presence of percent Vβ17+ CD8+ T cells identified as day 0, and after in vitro expansion with M1 peptide for 14 days (Day 14).

FIG. 7A shows FACS histograms of gated PBMCs for CD8+ T cells expressing Vβ17 (Vβ17+) on the cell surface from healthy subjects (left graph, Vβ17 non-depleted) and from PBMCs that were depleted of Vβ17+ T cells using negative selection (right graph, Vβ17 depleted). FIG. 7B shows specific binding of an anti-Vβ17/anti-CD123 bispecific antibody (VB11) and a Vβ17 null bispecific antibody (VB13) to CD8+ T cells from FIG. 7A. A dose response of bispecific antibodies is shown in the figure. The table below the graph shows $EC_{50}$ values for binding calculated from the above graph given in nM.

FIG. 9A shows FACS plots of Vβ17+ and Vβ17− gated CD8+ T cells. When T cells were activated with Vβ17 bispecific antibody there was high level of upregulation of CD69 (62.5%) on Vβ17+ as compared to Vβ17− CD8+ T cells (1.80%). FIG. 9B shows a bar graph for upregulation of CD69 on Vβ17+ and Vβ17− gated CD8+ T cells when activated using Vβ17 bispecific antibody.

FIG. 13 shows that the control antibody (B21M-Fab-RF× BCMB519-LH-scFv (B17B612.001)) does not bind T cells (left panel) and does not mediate T cell cytotoxicity against BCMA expressing H929 cells in vitro (right panel). Representative data shown here are from a single experiment.

FIG. 16A shows the cell cytolysis mediated by different concentrations of bispecific anti-DLL3×Vβ17 antibodies with E:T ratios of PAN-T:Tumor of 5:1 and Vβ17:Tumor of 0.25:1. FIG. 16B shows the cell cytolysis mediated by different concentrations of bispecific anti-DLL3×Vβ17 antibodies with E:T ratios of PAN-T:Tumor 10:1 and Vβ17:Tumor 0.5:1. Impedance was recorded every 15 minutes for 120 hours and the percent cytolysis was calculated on the RTCA software relative to HCC1833 tumor cells only.

FIG. 17A shows the cell cytolysis mediated by various concentrations of bispecific anti-DLL3×Vβ17 antibody in G361 with PAN-T: Tumor 5:1 and Vβ17:Tumor 0.25:1. FIG. 17B shows the cell cytolysis mediated by various concentrations of bispecific DLL3×Vβ17 antibody in G361 with PAN-T:Tumor 10:1 and Vβ17:Tumor 0.5:1.

FIG. 18A shows the cytotoxicity mediated by bispecific anti-DLL3×Vβ17 antibody at 90 nM against DLL3 expressing target cells at Effector to Target ratio (E:T) of 0.5:1, 0.25:1 and 0.125:1, respectively. FIG. 18B shows the cytotoxicity mediated by bispecific anti-DLL3×Vβ17 antibody at 30 nM against DLL3 expressing target cells at Effector to Target ratio (E:T) of 0.5:1, 0.25:1 and 0.125:1, respectively. FIG. 18C shows the cytotoxicity mediated by bispecific anti-DLL3×Vβ17 antibody at 10 nM against DLL3 expressing target cells at Effector to Target ratio (E:T) of 0.5:1, 0.25:1 and 0.125:1, respectively.

FIG. 19A shows the cytotoxicity mediated by bispecific anti-DLL3×Vβ17 antibody against DLL3 expressing target cells. Whole PBMCs from 2 donors were cultured with DLL3+ HCC1833-NLR at E:T ratios (Vβ17: target) of 1:1, 0.5:1 and 0.25:1, respectively, in the presence of the anti-DLL3×Vβ17 antibody. FIG. 19B shows the cytotoxicity mediated by bispecific anti-DLL3×Vβ17 antibody against DLL3 expressing target cells. Whole PBMCs from 2 donors were cultured with or G361-NLR cells at E:T ratios (Vβ17:target) of 1:1, 0.5:1 and 0.25:1, respectively, in the presence of the anti-DLL3×Vβ17 antibody.

FIG. 20A shows the % proliferation of Vβ17 T cells in response to different concentrations of anti-DLL3×Vβ17 antibody (DL3B588). FIG. 20B shows the frequency of Vβ17 T cells in response to different concentrations of anti-DLL3×Vβ17 (DL3B588) antibody.

FIG. 21A shows the cell cytolysis mediated by different concentrations of the bispecific anti-PSMA×Vβ17 antibody (VB17B3). FIG. 21B shows the cell cytolysis mediated by different concentrations of the bispecific anti-PSMA×Vβ17 antibody (VB17B4). FIG. 21C shows the cell cytolysis mediated by different concentrations of the bispecific anti-PSMA×Vβ17 antibody (VB17B5). FIG. 21D shows the cell cytolysis mediated by different concentrations of the bispecific anti-PSMA×Vβ17 antibody (VB17B6). Impedance was recorded every 15 minutes for 120 hours and the percent cytolysis was calculated on the RTCA software relative to C42b tumor cells only.

FIG. 22A shows binding quantified based on MFI values. FIG. 22B shows binding quantified based % binding. Both donors NHV21-07171 and NHV-07174 showed good binding of VB17B25 (Vβ17×PSMA) on Pan T cells. No binding of PSMB2951 (null×PSMA) antibody was observed on Pan T cells.

FIG. 24A shows that with whole PBMCs as effector cells, donors NHV21-07171 and NHV-07174 showed potent dose dependent cytotoxicity against C4-2B cells. No cytotoxicity was observed with the Null antibodies (VB17B23 and PSMB2951). FIG. 24B shows that with Pan T cells as effector cells, donor NHV21-07171 showed potent dose dependent cytotoxicity against C4-2B cells with VB17B25. No cytotoxicity was observed with the respective Null antibodies (VB17B23 and PSMB2951). No cytotoxicity was observed with the second donor (NHV21-07174) with the VB17B25 antibody. FIG. 24C shows that with whole PBMCs as effector cells, donors NHV21-08653 and NHV-08227 showed cytotoxicity against C4-2B cells, although donor NHV21-08227 showed only 20% max lysis of target cells. Donor NHV21-08653 showed potent cytotoxicity. FIG. 24C shows that with Pan T cells as effector cells, donors NHV21-08653 and NHV-08227 showed cytotoxicity against C4-2B cells, although donor NHV21-08227 showed only 20% max lysis of target cells. Donor NHV21-08653 showed potent cytotoxicity.

DETAILED DESCRIPTION

Figure 1:
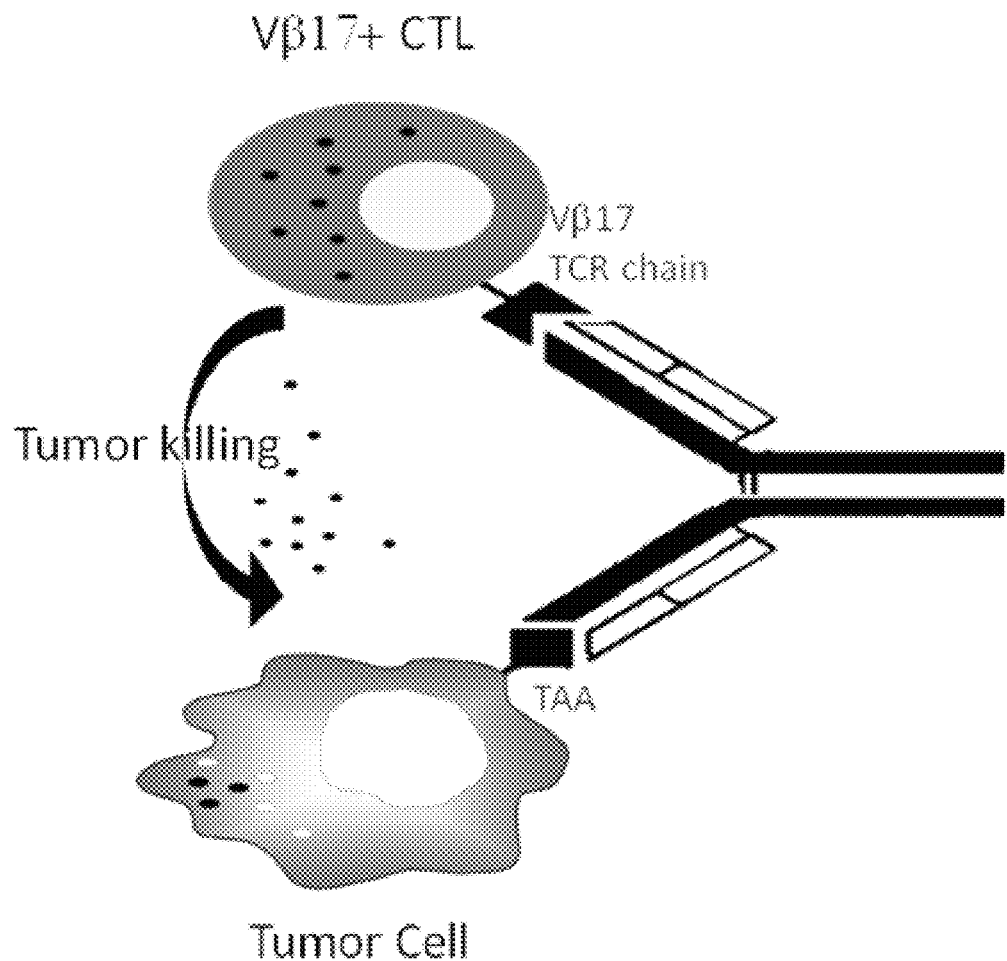
FIG. 1 shows the binding of an anti-Vβ17/anti-tumor antigen bispecific antibody to recruit T-cells to a cancer cell and to induce cancer cell death.

Various publications, articles and patents are cited or described in the background and throughout the specification; each of these references is herein incorporated by reference in its entirety. Discussion of documents, acts, materials, devices, articles or the like which has been included in the present specification is for the purpose of providing context for the invention. Such discussion is not an admission that any or all of these matters form part of the prior art with respect to any inventions disclosed or claimed.

Unless defined otherwise, all technical and scientific terms used herein have the same meaning as commonly understood to one of ordinary skill in the art to which this invention pertains. Otherwise, certain terms used herein have the meanings as set forth in the specification.

It must be noted that as used herein and in the appended claims, the singular forms "a," "an," and "the" include plural reference unless the context clearly dictates otherwise.

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

Unless otherwise indicated, the term "at least" preceding a series of elements is to be understood to refer to every element in the series. Those skilled in the art will recognize or be able to ascertain using no more than routine experimentation, many equivalents to the specific embodiments of the invention described herein. Such equivalents are intended to be encompassed by the invention.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers and are intended to be non-exclusive or open-ended. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the conjunctive term "and/or" between multiple recited elements is understood as encompassing both individual and combined options. For instance, where two elements are conjoined by "and/or," a first option refers to the applicability of the first element without the second. A second option refers to the applicability of the second element without the first. A third option refers to the applicability of the first and second elements together. Any one of these options is understood to fall within the meaning, and therefore satisfy the requirement of the term "and/or" as used herein. Concurrent applicability of more than one of the options is also understood to fall within the meaning, and therefore satisfy the requirement of the term "and/or."

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. § 2111.03.

As used herein, "subject" means any animal, preferably a mammal, most preferably a human. The term "mammal" as used herein, encompasses any mammal. Examples of mammals include, but are not limited to, cows, horses, sheep, pigs, cats, dogs, mice, rats, rabbits, guinea pigs, monkeys, humans, etc., more preferably a human.

It should also be understood that the terms "about," "approximately," "generally," "substantially," and like terms, used herein when referring to a dimension or characteristic of a component of the preferred invention, indicate that the described dimension/characteristic is not a strict boundary or parameter and does not exclude minor variations therefrom that are functionally the same or similar, as would be understood by one having ordinary skill in the art. At a minimum, such references that include a numerical parameter would include variations that, using mathematical and industrial principles accepted in the art (e.g., rounding, measurement or other systematic errors, manufacturing tolerances, etc.), would not vary the least significant digit.

The terms "identical" or percent "identity," in the context of two or more nucleic acids or polypeptide sequences (e.g., anti-Vβ17/anti-cancer-associated antigen bispecific antibodies and polynucleotides that encode them, anti-Vβ17/anti-CD123 bispecific antibodies and polynucleotides that encode them, Vβ17 polypeptides and Vβ17 polynucleotides that encode them, CD123 polypeptides and CD123 polynucleotides that encode them), refer to two or more sequences or subsequences that are the same or have a specified percentage of amino acid residues or nucleotides that are the same, when compared and aligned for maximum correspondence, as measured using one of the following sequence comparison algorithms or by visual inspection.

For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, WI), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)).

Examples of algorithms that are suitable for determining percent sequence identity and sequence similarity are the BLAST and BLAST 2.0 algorithms, which are described in Altschul et al. (1990) J. Mol. Biol. 215: 403-410 and Altschul et al. (1997) Nucleic Acids Res. 25: 3389-3402, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased.

Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word length (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix (see Henikoff & Henikoff, Proc. Natl. Acad. Sci. USA 89:10915 (1989)).

In addition to calculating percent sequence identity, the BLAST algorithm also performs a statistical analysis of the similarity between two sequences (see, e.g., Karlin & Altschul, Proc. Nat'l. Acad. Sci. USA 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

A further indication that two nucleic acid sequences or polypeptides are substantially identical is that the polypeptide encoded by the first nucleic acid is immunologically cross reactive with the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules hybridize to each other under stringent conditions.

As used herein, the term "polynucleotide," synonymously referred to as "nucleic acid molecule," "nucleotides" or "nucleic acids," refers to any polyribonucleotide or polydeoxyribonucleotide, which can be unmodified RNA or DNA or modified RNA or DNA. "Polynucleotides" include, without limitation single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. In addition, "polynucleotide" refers to triple-stranded regions comprising RNA or DNA or both RNA and DNA. The term polynucleotide also includes DNAs or RNAs containing one or more modified bases and DNAs or RNAs with backbones modified for stability or for other reasons. "Modified" bases include, for example, tritylated bases and unusual bases such as inosine. A variety of modifications can be made to DNA and RNA; thus, "polynucleotide" embraces chemically, enzymatically or metabolically modified forms of polynucleotides as typically found in nature, as well as the chemical forms of DNA and RNA characteristic of viruses and cells. "Polynucleotide" also embraces relatively short nucleic acid chains, often referred to as oligonucleotides.

As used herein, the term "vector" is a replicon in which another nucleic acid segment can be operably inserted so as to bring about the replication or expression of the segment.

As used herein, the term "host cell" refers to a cell comprising a nucleic acid molecule of the invention. The "host cell" can be any type of cell, e.g., a primary cell, a cell in culture, or a cell from a cell line. In one embodiment, a "host cell" is a cell transfected with a nucleic acid molecule disclosed herein. In another embodiment, a "host cell" is a progeny or potential progeny of such a transfected cell. A progeny of a cell may or may not be identical to the parent cell, e.g., due to mutations or environmental influences that can occur in succeeding generations or integration of the nucleic acid molecule into the host cell genome.

The term "expression" as used herein, refers to the biosynthesis of a gene product. The term encompasses the transcription of a gene into RNA. The term also encompasses translation of RNA into one or more polypeptides, and further encompasses all naturally occurring post-transcriptional and post-translational modifications. The expressed bispecific antibody can be within the cytoplasm of a host cell, into the extracellular milieu such as the growth medium of a cell culture or anchored to the cell membrane.

As used herein, the terms "peptide," "polypeptide," or "protein" can refer to a molecule comprised of amino acids and can be recognized as a protein by those of skill in the art. The conventional one-letter or three-letter code for amino acid residues is used herein. The terms "peptide," "polypeptide," and "protein" can be used interchangeably herein to refer to polymers of amino acids of any length. The polymer can be linear or branched, it can comprise modified amino acids, and it can be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art.

The peptide sequences described herein are written according to the usual convention whereby the N-terminal region of the peptide is on the left and the C-terminal region is on the right. Although isomeric forms of the amino acids are known, it is the L-form of the amino acid that is represented unless otherwise expressly indicated.

Antibodies

Provided herein are anti-Vβ17 antibodies or antigen-binding fragments thereof, nucleic acids and expression vectors encoding the antibodies, recombinant cells containing the vectors, and compositions comprising the antibodies. In certain embodiments, provided are isolated anti-Vβ17 bispecific antibodies or antigen-binding fragments thereof, nucleic acids and expression vectors encoding the antibodies, recombinant cells containing the vectors, and compositions comprising the bispecific antibodies. Methods of making the antibodies, and methods of using the antibodies to treat diseases are also provided. The antibodies disclosed herein possess one or more desirable functional properties, including but not limited to high-affinity binding to Vβ17 or high specificity to Vβ17. In certain embodiments, the antibodies disclosed herein possess the ability to treat or prevent a disease or disorder when administered to a subject alone or in combination with other therapies.

Also provided herein are anti-Vβ17 bispecific antibodies or antigen-binding fragments thereof, nucleic acids and expression vectors encoding the bispecific antibodies, recombinant cells containing the vectors, and compositions comprising the bispecific antibodies. Methods of making the antibodies, and methods of using the bispecific antibodies to treat diseases, including cancer, are also provided. The antibodies disclosed herein possess one or more desirable functional properties. In some embodiments, the bispecific antibodies provided herein have high-affinity binding to Vβ17. In some embodiments, the bispecific antibodies provided herein have high-affinity binding to a second target antigen. In some embodiments, the bispecific antibodies provided herein have high specificity to Vβ17. In some embodiments, the bispecific antibodies provided herein have high specificity to a second target antigen. In some, embodiments, the bispecific antibodies provided herein have high specificity to CD123. In some, embodiments, the bispecific antibodies provided herein have high specificity to BCMA. In some, embodiments, the bispecific antibodies provided herein have high specificity to DLL3. In some, embodiments, the bispecific antibodies provided herein have high specificity to PSMA. In some, embodiments, the bispecific antibodies provided herein have high specificity to KLK2. In some embodiments, the bispecific antibodies provided herein have the ability to treat or prevent a disease or disorder when administered alone. In some embodiments, the bispecific antibodies provided herein have the ability to treat or prevent a disease or disorder when administered in combination with other therapies. In some embodiments, the disease or disorder is a cancer. In some embodiments, the disease or disorder is a leukemia or lymphoma.

Also provided herein are anti-Vα10.2 antibodies or antigen-binding fragments thereof, nucleic acids and expression vectors encoding the antibodies, recombinant cells containing the vectors, and compositions comprising the antibodies. In certain embodiments, provided are isolated anti-Vα10.2 bispecific antibodies or antigen-binding fragments thereof, nucleic acids and expression vectors encoding the antibodies, recombinant cells containing the vectors, and compositions comprising the bispecific antibodies. Methods of making the antibodies, and methods of using the antibodies to treat diseases are also provided. The antibodies disclosed herein possess one or more desirable functional properties, including but not limited to high-affinity binding to Vα10.2 or high specificity to Vα10.2. In certain embodiments, the antibodies disclosed herein possess the ability to treat or prevent a disease or disorder when administered to a subject alone or in combination with other therapies. In some embodiments, the bispecific antibodies provided herein have high specificity to a second target antigen. In some, embodiments, the bispecific antibodies provided herein have high specificity to CD123. In some, embodiments, the bispecific antibodies provided herein have high specificity to BCMA. In some, embodiments, the bispecific antibodies provided herein have high specificity to DLL3. In some, embodiments, the bispecific antibodies provided herein have high specificity to PSMA. In some, embodiments, the bispecific antibodies provided herein have high specificity to KLK2. In some embodiments, the bispecific antibodies provided herein have the ability to treat or prevent a disease or disorder when administered alone. In some embodiments, the bispecific antibodies provided herein have the ability to treat or prevent a disease or disorder when administered in combination with other therapies. In some embodiments, the disease or disorder is a cancer. In some embodiments, the disease or disorder is a leukemia or lymphoma.

As used herein, the term "antibody" is used in a broad sense and includes immunoglobulin or antibody molecules including human, humanized, composite and chimeric antibodies and antibody fragments that are monoclonal or polyclonal. In general, antibodies are proteins or peptide chains that exhibit binding specificity to a specific antigen. Antibody structures are well known. Immunoglobulins can be assigned to five major classes (i.e., IgA, IgD, IgE, IgG and IgM), depending on the heavy chain constant domain amino acid sequence. IgA and IgG are further sub-classified as the isotypes IgA1, IgA2, IgG1, IgG2, IgG3 and IgG4. Accordingly, the antibodies provided herein can be of any of the five major classes or corresponding sub-classes. In specific embodiments, the antibodies provided herein are IgG1, IgG2, IgG3 or IgG4. Antibody light chains of vertebrate species can be assigned to one of two clearly distinct types, namely kappa and lambda, based on the amino acid sequences of their constant domains. Accordingly, the antibodies provided herein can contain a kappa or lambda light chain constant domain. According to particular embodiments, the antibodies disclosed herein include heavy and/or light chain constant regions from rat or human antibodies.

In addition to the heavy and light constant domains, antibodies contain an antigen-binding region that is made up of a light chain variable region (VL) and a heavy chain variable region (VH), each of which contains three domains (i.e., complementarity determining regions 1 (CDR1), CDR2 and CDR3. A "CDR" refers to one of three hypervariable regions (HCDR1, HCDR2 or HCDR3) within the non-framework region of the immunoglobulin (Ig or antibody) VH β-sheet framework, or one of three hypervariable regions (LCDR1, LCDR2 or LCDR3) within the non-framework region of the antibody VL β-sheet framework. Accordingly, CDRs are variable region sequences interspersed within the framework region sequences. CDR regions are well known to those skilled in the art and have been defined by, for example, Kabat as the regions of most hypervariability within the antibody variable (V) domains (Kabat et al., *J. Biol. Chem.* 252:6609-6616 (1977); Kabat, *Adv. Prot. Chem.* 32:1-75 (1978)). CDR region sequences also have been defined structurally by Chothia as those residues that are not part of the conserved β-sheet framework, and thus are able to adapt different conformations (Chothia and Lesk, J. Mol. Biol. 196:901-917 (1987)). Both terminologies are well recognized in the art. CDR region sequences have also been defined by AbM, Contact and IMGT. Exemplary CDR region sequences are illustrated herein, for example, in the Sequence Listing, and tables provided in the Examples below. The positions of CDRs within a canonical antibody variable region have been determined by comparison of numerous structures (A1-Lazikani et al., *J. Mol. Biol.* 273: 927-948 (1997); Morea et al., *Methods* 20:267-279 (2000)). Because the number of residues within a hypervariable region varies in different antibodies, additional residues relative to the canonical positions are conventionally numbered with a, b, c and so forth next to the residue number in the canonical variable region numbering scheme (A1-Lazikani et al., supra (1997)). Such nomenclature is similarly well known to those skilled in the art.

The light chain variable region CDR1 domain is interchangeably referred to herein as LCDR1 or VL CDR1. The light chain variable region CDR2 domain is interchangeably referred to herein as LCDR2 or VL CDR2. The light chain variable region CDR3 domain is interchangeably referred to herein as LCDR3 or VL CDR3. The heavy chain variable region CDR1 domain is interchangeably referred to herein as HCDR1 or VH CDR1. The heavy chain variable region CDR2 domain is interchangeably referred to herein as HCDR2 or VH CDR2. The heavy chain variable region CDR1 domain is interchangeably referred to herein as HCDR3 or VH CDR3.

The term "hypervariable region", such as a VH or VL, when used herein refers to the regions of an antibody variable region that are hypervariable in sequence and/or form structurally defined loops. Generally, antibodies comprise six hypervariable regions; three in the VH (HCDR1, HCDR2, HCDR3), and three in the VL (LCDR1, LCDR2, LCDR3). A number of hypervariable region delineations are in use and are encompassed herein. The "Kabat" CDRs are based on sequence variability and are the most commonly used (see, e.g., Kabat et al., *Sequences of Proteins of Immunological Interest,* 5th Ed. Public Health Service, National Institutes of Health, Bethesda, MD (1991)).

"Chothia" refers instead to the location of the structural loops (see, e.g., Chothia and Lesk, *J. Mol. Biol.* 196:901-917 (1987)). The end of the Chothia CDR-HCDR1 loop when numbered using the Kabat numbering convention varies between H32 and H34 depending on the length of the loop (this is because the Kabat numbering scheme places the insertions at H35A and H35B; if neither 35A nor 35B is present, the loop ends at 32; if only 35A is present, the loop ends at 33; if both 35A and 35B are present, the loop ends at 34). The "AbM" hypervariable regions represent a compromise between the Kabat CDRs and Chothia structural loops, and are used by Oxford Molecular's AbM antibody modeling software (see, e.g., Martin, in *Antibody Engineering*, Vol. 2, Chapter 3, Springer Verlag). "Contact" hypervariable regions are based on an analysis of the available complex crystal structures.

Recently, a universal numbering system has been developed and widely adopted, ImMunoGeneTics (IMGT) Information System® (Lafranc et al., *Dev. Comp. Immunol.* 27(1):55-77 (2003)). IMGT is an integrated information system specializing in immunoglobulins (IG), T cell receptors (TR) and major histocompatibility complex (MHC) of human and other vertebrates. Herein, the CDRs are referred to in terms of both the amino acid sequence and the location within the light or heavy chain. As the "location" of the CDRs within the structure of the immunoglobulin variable domain is conserved between species and present in structures called loops, by using numbering systems that align variable domain sequences according to structural features, CDR and framework residues and are readily identified. This information can be used in grafting and replacement of CDR residues from immunoglobulins of one species into an acceptor framework from, typically, a human antibody. An additional numbering system (AHon) has been developed by Honegger and Plückthun, *J. Mol. Biol.* 309: 657-670 (2001). Correspondence between the numbering system, including, for example, the Kabat numbering and the IMGT unique numbering system, is well known to one skilled in the art (see, e.g., Kabat, supra; Chothia and Lesk, supra; Martin, supra; Lefranc et al., supra). An Exemplary system, shown herein, combines Kabat and Chothia.

|  | Exemplary | IMGT | Kabat | AbM | Chothia | Contact |
|---|---|---|---|---|---|---|
| $V_H$ CDR1 | 26-35 | 27-38 | 31-35 | 26-35 | 26-32 | 30-35 |
| $V_H$ CDR2 | 50-65 | 56-65 | 50-65 | 50-58 | 53-55 | 47-58 |
| $V_H$ CDR3 | 95-102 | 105-117 | 95-102 | 95-102 | 96-101 | 93-101 |
| $V_L$ CDR1 | 24-34 | 27-38 | 24-34 | 24-34 | 26-32 | 30-36 |
| $V_L$ CDR2 | 50-56 | 56-65 | 50-56 | 50-56 | 50-52 | 46-55 |
| $V_L$ CDR3 | 89-97 | 105-117 | 89-97 | 89-97 | 91-96 | 89-96 |

Hypervariable regions may comprise "extended hypervariable regions" as follows: 24-36 or 24-34 (LCDR1), 46-56 or 50-56 (LCDR2) and 89-97 or 89-96 (LCDR3) in the VL and 26-35 or 26-35A (HCDR1), 50-65 or 49-65 (HCDR2) and 93-102, 94-102, or 95-102 (HCDR3) in the VH. CDR sequences, reflecting each of the above numbering schemes, are provided herein, including in the Sequence Listing.

The term "constant region" or "constant domain" refers to a carboxy terminal portion of the light and heavy chain which is not directly involved in binding of the antibody to antigen but exhibits various effector function, such as interaction with the Fc receptor. The terms refer to the portion of an immunoglobulin molecule having a more conserved amino acid sequence relative to the other portion of the immunoglobulin, the variable region, which contains the antigen binding site. The constant region may contain the CH1, CH2 and CH3 regions of the heavy chain and the CL region of the light chain.

The term "framework" or "FR" residues are those variable region residues flanking the CDRs. FR residues are present, for example, in chimeric, humanized, human, domain antibodies, diabodies, linear antibodies, and bispecific antibodies. FR residues are those variable domain residues other than the hypervariable region residues or CDR residues.

As used herein, the term an "isolated antibody" refers to an antibody which is substantially free of other antibodies having different antigenic specificities (e.g., an isolated antibody that specifically binds to Vβ17 is substantially free of antibodies that do not bind to Vβ17; an isolated antibody that specifically binds to a second target (e.g., CD123, BCMA, DLL3, PSMA or KLK2) is substantially free of antibodies that do not bind to the second target (e.g., CD123, BCMA, DLL3, PSMA or KLK2). In addition, an isolated antibody is substantially free of other cellular material and/or chemicals.

As used herein, the term "monoclonal antibody" refers to an antibody obtained from a population of substantially homogeneous antibodies, i.e., the individual antibodies comprising the population are identical except for possible naturally occurring mutations that can be present in minor amounts. The monoclonal antibodies disclosed herein can be made by the hybridoma method, phage display technology, single lymphocyte gene cloning technology, or by recombinant DNA methods. For example, the monoclonal antibodies can be produced by a hybridoma which includes a B cell obtained from a transgenic nonhuman animal, such as a transgenic mouse or rat, having a genome comprising a human heavy chain transgene and a light chain transgene.

As used herein, the term "antigen-binding fragment" refers to an antibody fragment such as, for example, a diabody, a Fab, a Fab', a F(ab')2, an Fv fragment, a disulfide stabilized Fv fragment (dsFv), a (dsFv)$_2$, a bispecific dsFv (dsFv-dsFv'), a disulfide stabilized diabody (ds diabody), a single-chain antibody molecule (scFv), a single domain antibody (sdAb) an scFv dimer (bivalent diabody), a multispecific antibody formed from a portion of an antibody comprising one or more CDRs, a camelized single domain antibody, a nanobody, a domain antibody, a bivalent domain antibody, or any other antibody fragment that binds to an antigen but does not comprise a complete antibody structure. An antigen-binding fragment is capable of binding to the same antigen to which the parent antibody or a parent antibody fragment binds. According to particular embodiments, the antigen-binding fragment comprises a light chain variable region, a light chain constant region, and an Fd segment of the heavy chain. According to other particular embodiments, the antigen-binding fragment comprises Fab and F(ab').

As used herein, the term "single-chain antibody" refers to a conventional single-chain antibody in the field, which comprises a heavy chain variable region and a light chain variable region connected by a short peptide of about 15 to about 20 amino acids. As used herein, the term "single domain antibody" refers to a conventional single domain antibody in the field, which comprises a heavy chain variable region and a heavy chain constant region or which comprises only a heavy chain variable region.

As used herein, the term "human antibody" refers to an antibody produced by a human or an antibody having an amino acid sequence corresponding to an antibody produced by a human made using any technique known in the art. This definition of a human antibody includes intact or full-length antibodies, fragments thereof, and/or antibodies comprising at least one human heavy and/or light chain polypeptide.

As used herein, the term "humanized antibody" refers to a non-human antibody that is modified to increase the sequence homology to that of a human antibody, such that the antigen-binding properties of the antibody are retained, but its antigenicity in the human body is reduced.

As used herein, the term "chimeric antibody" refers to an antibody wherein the amino acid sequence of the immunoglobulin molecule is derived from two or more species. The variable region of both the light and heavy chains often corresponds to the variable region of an antibody derived from one species of mammal (e.g., mouse, rat, rabbit, etc.) having the desired specificity, affinity, and capability, while the constant regions correspond to the sequences of an antibody derived from another species of mammal (e.g., human) to avoid eliciting an immune response in that species.

The term "specificity" refers to selective recognition of an antigen binding protein (such as an antibody) for a particular epitope of an antigen. Natural antibodies, for example, are monospecific. The term "multispecific" as used herein denotes that an antigen binding protein (such as an antibody) has two or more antigen-binding sites of which at least two bind different antigens. "Bispecific" as used herein denotes that an antigen binding protein has two different antigen-binding specificities.

As used herein, the term "multispecific antibody" refers to an antibody that comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, the first and second epitopes do not overlap or do not substantially overlap. In an embodiment, the first and second epitopes are on different antigens, e.g., the different proteins (or different subunits of a multimeric protein). In an embodiment, a multispecific antibody comprises a third, fourth, or fifth immunoglobulin variable domain. In an embodiment, a multispecific antibody is a bispecific antibody molecule, a trispecific antibody molecule, or a tetraspecific antibody molecule.

As used herein, the term "bispecific antibody" refers to a multispecific antibody that binds no more than two epitopes or two antigens. A bispecific antibody is characterized by a first immunoglobulin variable domain sequence which has binding specificity for a first epitope (e.g., an epitope on a Vβ17 antigen) and a second immunoglobulin variable domain sequence that has binding specificity for a second epitope. In an embodiment, the first and second epitopes are on different antigens, e.g., the different proteins (or different subunits of a multimeric protein). In an embodiment, a bispecific antibody comprises a heavy chain variable domain sequence and a light chain variable domain sequence which have binding specificity for a first epitope and a heavy chain variable domain sequence and a light chain variable domain sequence which have binding specificity for a second epitope. In an embodiment, a bispecific antibody comprises a half antibody, or fragment thereof, having binding specificity for a first epitope and a half antibody, or fragment thereof, having binding specificity for a second epitope. In an embodiment, a bispecific antibody comprises a scFv, or fragment thereof, having binding specificity for a first epitope, and a scFv, or fragment thereof, having binding specificity for a second epitope. In an embodiment, the first epitope is located on Vβ17 and the second epitope is located on CD123. In an embodiment, the first epitope is located on Vβ17 and the second epitope is located on PD-1, PD-L1, CTLA-4, EGFR, HER-2, CD19, CD20, CD3 and/or other tumor associated immune suppressors or surface antigens. In an embodiment, the first epitope is located on Vβ17 and the second epitope is located on BCMA. In an embodiment, the first epitope is located on Vβ17 and the second epitope is located on DLL3. In an embodiment, the first epitope is located on Vβ17 and the second epitope is located on PSMA. In an embodiment, the first epitope is located on Vβ17 and the second epitope is located on KLK2.

The term "valent" as used herein denotes the presence of a specified number of binding sites in an antigen binding protein (such as an antibody). A natural antibody for example or a full length antibody has two binding sites and is bivalent. As such, the terms "trivalent", "tetravalent", "pentavalent" and "hexavalent" denote the presence of two binding site, three binding sites, four binding sites, five binding sites, and six binding sites, respectively, in an antigen binding protein (such as an antibody).

The term "half antibody" as used herein refers to one immunoglobulin heavy chain associated with one immunoglobulin light chain. One skilled in the art will readily appreciate that a half-antibody can encompass a fragment thereof and can also have an antigen binding domain consisting of a single variable domain, e.g., originating from a camelidae.

As used herein, the term "Vβ17" refers to a T cell receptor, which is expressed in response to an immune response on a cytotoxic T cell. Vβ17-expressing CD8+ T cells are commonly produced in response to influenza A virus exposure in a subject. Vβ17-expressing CD8+ T cells provide great recall in response to influenza exposure in the subject. The term "Vβ17" includes any Vβ17 variant, isoform, and species homolog, which is naturally expressed by cells (including T cells) or can be expressed on cells transfected with genes or cDNA encoding the polypeptide. Unless noted, preferably the Vβ17 is a human Vβ17. An exemplary human Vβ17 amino acid sequence is provided by GenBank Accession Number AAB49730.1.

The term "CD123" refers to a molecule that is found on cells which helps transmit the signal of interleukin-3, a soluble cytokine that is important in the immune system. CD123 can also be referred to as the "interleukin-3 receptor." The receptor belongs to the type I cytokine receptor family and is a heterodimer with a unique alpha chain paired with the common beta subunit (beta c or CD131). The CD123 receptor can be found on pluripotent progenitor cells and can induce tyrosine phosphorylation within the cell and promote proliferation and differentiation within hematopoietic cell lines. CD123 can also be expressed in acute myeloid leukemia (AML) subtypes. The term "CD123" includes any CD123 variant, isoform, and species homolog, which is naturally expressed by cells (including T cells) or can be expressed on cells transfected with genes or cDNA encoding those polypeptides, unless noted, preferably the "CD123" is a human CD123. A human CD123 amino acid sequence is provided by GenBank Accession Number AY789109.1.

The term "BCMA" as used herein relates to human B cell maturation antigen, also known as BCMA, CD269, and TNFRSF17 (UniProt Q02223), which is a member of the tumor necrosis receptor superfamily that is preferentially expressed in differentiated plasma cells. An exemplary human BCMA nucleotide sequence is provided by GenBank Accession Number BC058291. There are four major haplotypes of the BCMA gene in the human genome, and in the present disclosure the term "BCMA" is meant to encompass all four (Kawasaki et al., Genes Immun. 2:276-9, 2001). The extracellular domain of human BCMA consists of, according to UniProt, amino acids 1-54 (or 5-51). The term "antibody against BCMA, anti-BCMA antibody" as used herein relates to an antibody specifically binding to BCMA.

The term "DLL3" as used herein refers to a molecule that is found on cells that acts as an inhibitory Notch pathway ligand. DLL3 can also be referred to as "Delta-like ligand 3." The term "DLL3" includes any DLL3 variant, isoform, and species homolog, which is naturally expressed by cells (including tumor cells) or can be expressed on cells transfected with genes or cDNA encoding the polypeptide. In specific embodiments, the DLL3 is a human DLL3. The extracellular domain of human DLL3 consists of, according to UniProt, amino acids 27-492. The term "antibody against DLL3" or "anti-DLL3 antibody" as used herein relates to an antibody specifically binding to DLL3.

As used herein, the term "prostate-specific membrane antigen" or "PSMA" refers to a type II membrane protein expressed on certain cells. The term "PSMA" as used herein includes the protein referred as HGNC: 3788, Entrez Gene: 2346, Ensembl: ENSG00000086205, OMIM: 600934, and UniProtKB: Q04609. The term "PSMA" includes any PSMA variant, isoform, and species homolog, which is naturally expressed by cells (including prostate cells) or can be expressed on cells transfected with genes or cDNA encoding the polypeptide. In specific embodiments, the PSMA is a human PSMA. The term "antibody against PSMA" or "anti-PSMA antibody" as used herein relates to an antibody specifically binding to PSMA.

The term "KLK2" (also known as Kallikrein Related Peptidase 2) as used herein refers to a member of the grandular kallikrein protein family. Kallikreins are a subgroup of serine proteases that are clustered on chromosome 19. Members of this family are involved in a diverse array of biological functions. This protein is primarily expressed in prostatic tissue and is responsible for cleaving pro-prostate-specific antigen into its enzymatically active form. It is also referred as HGNC: 6363, Entrez Gene: 3817, Ensembl: ENSG00000167751, OMIM: 147960, and UniProtKB: P20151. The term "KLK2" includes any KLK2 variant, isoform, and species homolog, which is naturally expressed by cells (including tumor cells) or can be expressed on cells transfected with genes or cDNA encoding the polypeptide. In specific embodiments, the KLK2 is a human KLK2. The term "antibody against KLK2" or "anti-KLK2 antibody" as used herein relates to an antibody specifically binding to KLK2.

As used herein, an antibody that "specifically binds to Vβ17" refers to an antibody that binds to a Vβ17, preferably a human Vβ17, with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less.

As used herein, an antibody that "specifically binds to Vα10.2" refers to an antibody that binds to a Vα10.2, preferably a human Vα10.2, with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less.

As used herein, an antibody that "specifically binds to a second target antigen" refers to an antibody that binds to a second target antigen with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less.

As used herein, an antibody that "specifically binds to CD123" refers to an antibody that binds to a CD123, preferably a human CD123, with a KD of $1\times10^{-7}$ M or less, preferably $1\times10^{-8}$ M or less, more preferably $5\times10^{-9}$ M or less, $1\times10^{-9}$ M or less, $5\times10^{-10}$ M or less, or $1\times10^{-10}$ M or less.

As used herein, an antibody that "specifically binds to BCMA" refers to an antibody that binds to a BCMA, e.g., a human BCMA, with a KD of $1\times10^{-7}$ M or less, preferably $1\times10^{-8}$ M or less, more preferably $5\times10^{-9}$ M or less, $1\times10^{-9}$ M or less, $5\times10^{-10}$ M or less, or $1\times10^{-10}$ M or less.

As used herein, an antibody that "specifically binds to DLL3" refers to an antibody that binds to a DLL3, e.g., a human DLL3, with a KD of $1\times10^{-7}$ M or less, preferably $1\times10^{-8}$ M or less, more preferably $5\times10^{-9}$ M or less, $1\times10^{-9}$ M or less, $5\times10^{-10}$ M or less, or $1\times10^{-10}$ M or less.

As used herein, an antibody that "specifically binds to PSMA" refers to an antibody that binds to a PSMA, e.g., a human PSMA, with a KD of $1\times10^{-7}$ M or less, preferably $1\times10^{-8}$ M or less, more preferably $5\times10^{-9}$ M or less, $1\times10^{-9}$ M or less, $5\times10^{-10}$ M or less, or $1\times10^{-10}$ M or less.

As used herein, an antibody that "specifically binds to KLK2" refers to an antibody that binds to a KLK2, e.g., a human KLK2, with a KD of $1\times10^{-7}$ M or less, preferably $1\times10^{-8}$M or less, more preferably $5\times10^{-9}$ M or less, $1\times10^{-9}$ M or less, $5\times10^{-10}$ M or less, or $1\times10^{-10}$ M or less.

As used herein, an antigen binding domain or antigen binding fragment that "specifically binds to a tumor-associated antigen" refers to an antigen binding domain or antigen binding fragment that binds a tumor-associated antigen, with a KD of $1\times10^{-7}$ M or less, such as $1\times10^{-8}$ M or less, $5\times10^{-9}$ M or less, $1\times10^{-9}$ M or less, $5\times10^{-10}$ M or less, or $1\times10^{-10}$ M or less.

The term "KD" refers to the dissociation constant, which is obtained from the ratio of Kd to Ka (i.e., Kd/Ka) and is expressed as a molar concentration (M). KD values for antibodies can be determined using methods in the art in view of the present disclosure. For example, the KD of an antibody can be determined by using surface plasmon resonance, such as by using a biosensor system, e.g., a Biacore® system, or by using bio-layer interferometry technology, such as an Octet RED96 system.

The smaller the value of the KD of an antibody, the higher affinity that the antibody binds to a target antigen.

According to a particular aspect, the invention relates to an isolated Vβ17 bispecific antibody or antigen-binding fragment thereof comprising (a) a first heavy chain (HC1); (b) a second heavy chain (HC2); (c) a first light chain (LC1); and (d) a second light chain (LC2). The HC1 can be associated with the LC1 and the HC2 can be associated with LC2. The HC1 can comprise a heavy chain complementarity determining region 1 (HCDR1), HCDR2, and HCDR3 comprising the amino acid sequences of SEQ ID NO:1, SEQ ID NO:2, and SEQ ID NO:3, respectively, and LC1 can comprise a light chain complementarity determining region 1 (LCDR1), LCDR2, and LCDR3 comprising the amino acid sequences of SEQ ID NO:4, SEQ ID NO:5, and SEQ ID NO:6, respectively.

In one aspect, provided herein is an antibody that binds to Vβ17. In some embodiments, the antibody comprises a heavy chain variable region and a light chain variable region. In a some embodiments, the Vβ17 antibody is not a single domain antibody or nanobody. In some embodiments, the Vβ17 antibody is a humanized antibody.

In certain embodiments, provided herein is an anti-Vβ17 antibody comprising a VH region, VL region, VH CDR1, VH CDR2, VH CDR3, VL CDR1, VL CDR2, and/or VL CDR3 of any one of the antibodies described herein. In some embodiments, provided herein is an anti-Vβ17 antibody comprising a VH region of any one of the antibodies described herein. In some embodiments, provided herein is an anti-Vβ17 antibody comprising a VL region of any one of the antibodies described herein. In some embodiments, provided herein is an anti-Vβ17 antibody comprising a VH region of any one of the antibodies described herein, and a VL region of any one of the antibodies described herein. In some embodiments, provided herein is an anti-Vβ17 antibody comprising a VH CDR1, VH CDR2, and VH CDR3 of any one of the antibodies described herein. In some embodiments, provided herein is an anti-Vβ17 antibody comprising a VL CDR1, VL CDR2, and VL CDR3 of any one of the antibodies described herein. In some embodiments, provided herein is an anti-Vβ17 antibody comprising a VH CDR1, VH CDR2, and VH CDR3 of any one of the antibodies described herein; and a VL CDR1, VL CDR2, and VL CDR3 of any one of the antibodies described herein. Representative VH and VL amino acid sequences, including VH CDR1, VH CDR2, VH CDR3, VL CDR1, VL CDR2 and VL CDR3 amino acid sequences, of Vβ17 antibodies provided herein are provided in the Sequence Listing, as well as Tables 1-21.

In certain embodiments, provided herein is an anti-Vβ17 bispecific antibody comprising a binding domain that binds to Vβ17 having a VH region, VL region, VH CDR1, VH CDR2, VH CDR3, VL CDR1, VL CDR2, and/or VL CDR3 of any one of the antibodies described herein. In some embodiments, provided herein is an anti-Vβ17 bispecific antibody comprising a binding domain that binds to Vβ17 having a VH region of any one of the antibodies described herein. In some embodiments, provided herein is an anti-Vβ17 bispecific antibody comprising a binding domain that binds to Vβ17 having a VL region of any one of the antibodies described herein. In some embodiments, provided herein is an anti-Vβ17 bispecific antibody comprising a binding domain that binds to Vβ17 having a VH region of any one of the antibodies described herein, and a VL region of any one of the antibodies described herein. In some embodiments, provided herein is an anti-Vβ17 bispecific antibody comprising a binding domain that binds to Vβ17 having a VH CDR1, VH CDR2, and VH CDR3 of any one of the antibodies described. In some embodiments, provided herein is an anti-Vβ17 bispecific antibody comprising a binding domain that binds to Vβ17 having a VL CDR1, VL CDR2, and VL CDR3 of any one of the antibodies described herein. In some embodiments, provided herein is an anti-Vβ17 bispecific antibody comprising a binding domain that binds to Vβ17 having a VH CDR1, VH CDR2, and VH CDR3 of any one of the antibodies described herein; and a VL CDR1, VL CDR2, and VL CDR3 of any one of the antibodies described herein. Exemplary Vβ17 antibodies are provided in the Sequence Listing, as well as the Figures, and Tables in the Examples section. Exemplary first binding domains that bind to Vβ17 are provided in the Sequence Listing, as well as the Figures, and Tables in the Examples section.

In certain embodiments, the anti-Vβ17 antibody is a bispecific antibody. In some embodiments, the anti-Vβ17 bispecific antibody further comprises a second binding domain that binds to CD123 having a VH region, VL region, VH CDR1, VH CDR2, VH CDR3, VL CDR1, VL CDR2, and/or VL CDR3 of an anti-CD123 antibody provided herein. In some embodiments, the anti-Vβ17 bispecific antibody further comprises a second binding domain that binds to CD123 having a VH region of an anti-CD123 antibody provided herein. In some embodiments, the anti-Vβ17 bispecific antibody further comprises a second binding domain that binds to CD123 having a VL region of an anti-CD123 antibody provided herein. In some embodiments, the anti-Vβ17 bispecific antibody further comprises a second binding domain that binds to CD123 having a VH region of an anti-CD123 antibody provided herein, and a VL region of an anti-CD123 antibody provided herein. In some embodiments, the anti-Vβ17 bispecific antibody further comprises a second binding domain that binds to CD123 having a VH CDR1, VH CDR2, and VH CDR3 of an anti-CD123 antibody provided herein. In some embodiments, the anti-Vβ17 bispecific antibody further comprises a second binding domain that binds to CD123 having a VL CDR1, VL CDR2, and VL CDR3 of an anti-CD123 antibody provided herein. In some embodiments, the anti-Vβ17 bispecific antibody further comprises a second binding domain that binds to CD123 having a VH CDR1, VH CDR2, and VH CDR3 of an anti-CD123 antibody provided herein, and a VL CDR1, VL CDR2, and VL CDR3 of an anti-CD123 antibody provided herein. Exemplary CD123 antibodies are provided in the Sequence Listing, as well as the Figures, and Tables in the Examples section. Exemplary second binding domains that bind to CD123 are provided in the Sequence Listing, as well as the Figures, and Tables in the Examples section.

In certain embodiments, the anti-Vβ17 antibody is a bispecific antibody. In some embodiments, the anti-Vβ17 bispecific antibody further comprises a second binding domain that binds to BCMA having a VH region, VL region, VH CDR1, VH CDR2, VH CDR3, VL CDR1, VL CDR2, and/or VL CDR3 of an anti-BCMA antibody provided herein. In some embodiments, the anti-Vβ17 bispecific antibody further comprises a second binding domain that binds to BCMA having a VH region of an anti-BCMA antibody provided herein. In some embodiments, the anti-Vβ17 bispecific antibody further comprises a second binding domain that binds to BCMA having a VL region of an anti-BCMA antibody provided herein. In some embodiments, the anti-Vβ17 bispecific antibody further comprises a second binding domain that binds to BCMA having a VH region of an anti-BCMA antibody provided herein, and a VL region of an anti-BCMA antibody provided herein. In some embodiments, the anti-Vβ17 bispecific antibody further comprises a second binding domain that binds to BCMA having a VH CDR1, VH CDR2, and VH CDR3 of an anti-BCMA antibody provided herein. In some embodiments, the anti-Vβ17 bispecific antibody further comprises a second binding domain that binds to BCMA having a VL CDR1, VL CDR2, and VL CDR3 of an anti-BCMA antibody provided herein. In some embodiments, the anti-Vβ17 bispecific antibody further comprises a second binding domain that binds to BCMA having a VH CDR1, VH CDR2, and VH CDR3 of an anti-BCMA antibody provided herein, and a VL CDR1, VL CDR2, and VL CDR3 of an anti-BCMA antibody provided herein. Exemplary BCMA antibodies are provided in the Sequence Listing, as well as the Figures, and Tables in the Examples section. Exemplary second binding domains that bind to BCMA are provided in the Sequence Listing, as well as the Figures, and Tables in the Examples section.

In certain embodiments, the anti-Vβ17 antibody is a bispecific antibody. In some embodiments, the anti-Vβ17 bispecific antibody further comprises a second binding domain that binds to DLL3 having a VH region, VL region, VH CDR1, VH CDR2, VH CDR3, VL CDR1, VL CDR2, and/or VL CDR3 of an anti-DLL3 antibody provided herein. In some embodiments, the anti-Vβ17 bispecific antibody further comprises a second binding domain that binds to DLL3 having a VH region of an anti-DLL3 antibody provided herein. In some embodiments, the anti-Vβ17 bispecific antibody further comprises a second binding domain that binds to DLL3 having a VL region of an anti-DLL3 antibody provided herein. In some embodiments, the anti-Vβ17 bispecific antibody further comprises a second binding domain that binds to DLL3 having a VH region of an anti-DLL3 antibody provided herein, and a VL region of an anti-DLL3 antibody provided herein. In some embodiments, the anti-Vβ17 bispecific antibody further comprises a second binding domain that binds to DLL3 having a VH CDR1, VH CDR2, and VH CDR3 of an anti-DLL3 antibody provided herein. In some embodiments, the anti-Vβ17 bispecific antibody further comprises a second binding domain that binds to DLL3 having a VL CDR1, VL CDR2, and VL CDR3 of an anti-DLL3 antibody provided herein. In some embodiments, the anti-Vβ17 bispecific antibody further comprises a second binding domain that binds to DLL3 having a VH CDR1, VH CDR2, and VH CDR3 of an anti-DLL3 antibody provided herein, and a VL CDR1, VL CDR2, and VL CDR3 of an anti-DLL3 antibody provided herein. Exemplary DLL3 antibodies are provided in the Sequence Listing, as well as the Figures, and Tables in the Examples section. Exemplary second binding domains that bind to DLL3 are provided in the Sequence Listing, as well as the Figures, and Tables in the Examples section.

In certain embodiments, the anti-Vβ17 antibody is a bispecific antibody. In some embodiments, the anti-Vβ17 bispecific antibody further comprises a second binding domain that binds to PSMA having a VH region, VL region, VH CDR1, VH CDR2, VH CDR3, VL CDR1, VL CDR2, and/or VL CDR3 of an anti-PSMA antibody provided herein. In some embodiments, the anti-Vβ17 bispecific antibody further comprises a second binding domain that binds to PSMA having a VH region of an anti-PSMA antibody provided herein. In some embodiments, the anti-Vβ17 bispecific antibody further comprises a second binding domain that binds to PSMA having a VL region of an anti-PSMA antibody provided herein. In some embodiments, the anti-Vβ17 bispecific antibody further comprises a second binding domain that binds to PSMA having a VH region of an anti-PSMA antibody provided herein, and a VL region of an anti-PSMA antibody provided herein. In some embodiments, the anti-Vβ17 bispecific antibody further comprises a second binding domain that binds to PSMA having a VH CDR1, VH CDR2, and VH CDR3 of an anti-PSMA antibody provided herein. In some embodiments, the anti-Vβ17 bispecific antibody further comprises a second binding domain that binds to PSMA having a VL CDR1, VL CDR2, and VL CDR3 of an anti-PSMA antibody provided herein. In some embodiments, the anti-Vβ17 bispecific antibody further comprises a second binding domain that binds to PSMA having a VH CDR1, VH CDR2, and VH CDR3 of an anti-PSMA antibody provided herein, and a VL CDR1, VL CDR2, and VL CDR3 of an anti-PSMA antibody provided herein. Exemplary PSMA antibodies are provided in the Sequence Listing, as well as the Figures, and Tables in the Examples section. Exemplary second binding domains that bind to PSMA are provided in the Sequence Listing, as well as the Figures, and Tables in the Examples section.

In certain embodiments, the anti-Vβ17 antibody is a bispecific antibody. In some embodiments, the anti-Vβ17 bispecific antibody further comprises a second binding domain that binds to KLK2 having a VH region, VL region, VH CDR1, VH CDR2, VH CDR3, VL CDR1, VL CDR2, and/or VL CDR3 of an anti-KLK2 antibody provided herein. In some embodiments, the anti-Vβ17 bispecific antibody further comprises a second binding domain that binds to KLK2 having a VH region of an anti-KLK2 antibody provided herein. In some embodiments, the anti-Vβ17 bispecific antibody further comprises a second binding domain that binds to KLK2 having a VL region of an anti-KLK2 antibody provided herein. In some embodiments, the anti-Vβ17 bispecific antibody further comprises a second binding domain that binds to KLK2 having a VH region of an anti-KLK2 antibody provided herein, and a VL region of an anti-KLK2 antibody provided herein. In some embodiments, the anti-Vβ17 bispecific antibody further comprises a second binding domain that binds to KLK2 having a VH CDR1, VH CDR2, and VH CDR3 of an anti-KLK2 antibody provided herein. In some embodiments, the anti-Vβ17 bispecific antibody further comprises a second binding domain that binds to KLK2 having a VL CDR1, VL CDR2, and VL CDR3 of an anti-KLK2 antibody provided herein. In some embodiments, the anti-Vβ17 bispecific antibody further comprises a second binding domain that binds to KLK2 having a VH CDR1, VH CDR2, and VH CDR3 of an anti-KLK2 antibody provided herein, and a VL CDR1, VL CDR2, and VL CDR3 of an anti-KLK2 antibody provided herein. Exemplary KLK2 antibodies are provided in the Sequence Listing, as well as the Figures, and Tables in the Examples section. Exemplary second binding domains that bind to KLK2 are provided in the Sequence Listing, as well as the Figures, and Tables in the Examples section.

In certain embodiments, provided is an anti-Vβ17 antibody that is an intact antibody. In other embodiments, provided is an anti-Vβ17 antibody is an antigen binding fragment of the anti-Vβ17 antibody. In some embodiments, the antigen binding fragment of the anti-Vβ17 antibody is a functional fragment. In some embodiments, the antigen binding fragment is a diabody. In some embodiments, the antigen binding fragment is a Fab. In some embodiments, the antigen binding fragment is a Fab'. In some embodiments, the antigen binding fragment is a F(ab')2. In some embodiments, the antigen binding fragment is a Fv fragment. In some embodiments, the antigen binding fragment is a disulfide stabilized Fv fragment (dsFv). In some embodiments, the antigen binding fragment is a (dsFv)$_2$. In some embodiments, the antigen binding fragment is a bispecific dsFv (dsFv-dsFv'). In some embodiments, the antigen binding fragment is a disulfide stabilized diabody (ds diabody). In some embodiments, the antigen binding fragment is a single-chain antibody molecule (scFv). In some embodiments, the antigen binding fragment is a single domain antibody (sdAb). In some embodiments, the antigen binding fragment is an scFv dimer (bivalent diabody). In some embodiments, the antigen binding fragment is a multispecific antibody formed from a portion of an antibody comprising one or more CDRs. In some embodiments, the antigen binding fragment is a camelized single domain antibody. In some embodiments, the antigen binding fragment is a nanobody. In some embodiments, the antigen binding fragment is a domain antibody. In some embodiments, the antigen binding fragment is a bivalent domain antibody. In some embodiments, the antigen binding fragment is an antibody fragment that binds to an antigen but does not comprise a complete antibody structure.

In specific embodiments, the anti-Vβ17 antibody comprises a VH region and a VL region.

In some embodiments, the anti-Vβ17 antibody is a single chain antibody. In some embodiments, the anti-Vβ17 antibody is a single domain antibody. In some embodiments, the anti-Vβ17 antibody is a nanobody. In certain embodiments, the anti-Vβ17 antibody is a VHH antibody. In certain embodiments, the anti-Vβ17 antibody is a llama antibody. In some embodiments, the anti-Vβ17 bispecific antibody comprises a single chain antibody. In some embodiments, the anti-Vβ17 bispecific antibody comprises a single domain antibody. In certain embodiments, the anti-Vβ17 bispecific antibody comprises a nanobody. In certain embodiments, the anti-Vβ17 bispecific antibody comprises a VHH antibody. In certain embodiments, the anti-Vβ17 bispecific antibody comprises a llama antibody. In some embodiments, the anti-Vβ17 antibody is not a single chain antibody. In some embodiments, the anti-Vβ17 antibody is not a single domain antibody. In some embodiments, the anti-Vβ17 antibody is not a nanobody. In certain embodiments, the anti-Vβ17 antibody is not a VHH antibody. In certain embodiments, the anti-Vβ17 antibody is not a llama antibody. In some embodiments, the anti-Vβ17 bispecific antibody does not comprise a single chain antibody. In some embodiments, the anti-Vβ17 bispecific antibody does not comprise a single domain antibody. In certain embodiments, the anti-Vβ17 bispecific antibody does not comprise a nanobody. In certain embodiments, the anti-Vβ17 bispecific antibody does not comprise a VHH antibody. In certain embodiments, the anti-Vβ17 bispecific antibody does not comprise a llama antibody.

In some embodiments, the anti-Vβ17 antibody is a multispecific antibody. In other embodiments, the anti-Vβ17 is a bispecific antibody. In certain embodiments, the multispecific antibody comprises an antigen binding fragment of an anti-Vβ17 antibody provided herein. In other embodiments, the bispecific antibody comprises an antigen binding fragment of an anti-Vβ17 antibody provided herein. In some embodiments, the anti-Vβ17 antibody is an agonistic antibody. In certain embodiments, the anti-Vβ17 antibody activates T cells. In other embodiments, the anti-Vβ17 antibody is an antagonistic antibody. In certain embodiments, the anti-Vβ17 antibody inactivates T cells. In some embodiments, the anti-Vβ17 antibody blocks activation of T cells. In some embodiments, the anti-Vβ17 antibody modulates the activity of T cells. In some embodiments, the anti-Vβ17 antibody neither activates or inactivates the activity of T cells. In specific embodiments, the T cells are human T cells. In specific embodiments, provided is a bispecific antibody comprising a Vβ17 antibody provided herein in a knob-in-hole format. In some embodiments, an anti-Vβ17 antibody provided herein may be comprised in a bispecific antibody. In some embodiments, an anti-Vβ17 bispecific antibody provided herein may be comprised in a multispecific antibody. In certain embodiments, a bispecific antibody provided herein comprises a first binding domain comprising an anti-Vβ17 antibody provided herein that binds to a first Vβ17 epitope, and a second binding domain comprising an anti-Vβ17 antibody provided herein that binds to a second Vβ17 epitope, wherein the first Vβ17 epitope and the second Vβ17 epitope are not the same. In a specific embodiment, a Vβ17 antibody, or antigen binding fragment thereof, provided herein specifically binds to Vβ17. In certain embodiments, a Vβ17 antibody, or antigen binding fragment thereof, provided herein does not bind to an epitope of Vβ17.

In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system. Exemplary sets of 6 CDRs (VH CDR1-3 and VL CDR1-3) of certain antibody embodiments are provided herein. Other sets of CDRs are contemplated and within the scope of the antibody embodiments provided herein.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:97, a VH CDR2 having an amino acid sequence of SEQ ID NO:98, and a VH CDR3 having an amino acid sequence of SEQ ID NO:99; and (ii) a VL comprising a VL CDR1 having an amino acid sequence of SEQ ID NO:100, a VL CDR2 having an amino acid sequence of SEQ ID NO:101, and a VL CDR3 having an amino acid sequence of SEQ ID NO:102. In another aspect, provided herein is an antibody that binds Vβ17, comprising: (i) a VH comprising a VH CDR1 having an amino acid sequence of SEQ ID NO:103, a VH CDR2 having an amino acid sequence of SEQ ID NO:104, and a VH CDR3 having an amino acid sequence of SEQ ID NO:105; and (ii) a VL comprising a VL CDR1 having an amino acid sequence of SEQ ID NO:106, a VL CDR2 having an amino acid sequence of SEQ ID NO:107, and a VL CDR3 having an amino acid sequence of SEQ ID NO:108. In another aspect, provided herein is an antibody that binds Vβ17, comprising: (i) a VH comprising a VH CDR1 having an amino acid sequence of SEQ ID NO:109, a VH CDR2 having an amino acid sequence of SEQ ID NO:110, and a VH CDR3 having an amino acid sequence of SEQ ID NO:111; and (ii) a VL comprising a VL CDR1 having an amino acid sequence of SEQ ID NO:112, a VL CDR2 having an amino acid sequence of SEQ ID NO:113, and a VL CDR3 having an amino acid sequence of SEQ ID NO:114. In another aspect, provided herein is an antibody that binds Vβ17, comprising: (i) a VH comprising a VH CDR1 having an amino acid sequence of SEQ ID NO:115, a VH CDR2 having an amino acid sequence of SEQ ID NO:116, and a VH CDR3 having an amino acid sequence of SEQ ID NO:117; and (ii) a VL comprising a VL CDR1 having an amino acid sequence of SEQ ID NO:118, a VL CDR2 having an amino acid sequence of SEQ ID NO:119, and a VL CDR3 having an amino acid sequence of SEQ ID NO:120. In another aspect, provided herein is an antibody that binds Vβ17, comprising: (i) a VH comprising a VH CDR1 having an amino acid sequence of SEQ ID NO:121, a VH CDR2 having an amino acid sequence of SEQ ID NO:122, and a VH CDR3 having an amino acid sequence of SEQ ID NO:123; and (ii) a VL comprising a VL CDR1 having an amino acid sequence of SEQ ID NO:124, a VL CDR2 having an amino acid sequence of SEQ ID NO:125, and a VL CDR3 having an amino acid sequence of SEQ ID NO:126. In another aspect, provided herein is an antibody that binds Vβ17, comprising:

(i) a VH comprising a VH CDR1 having an amino acid sequence of SEQ ID NO:127, a VH CDR2 having an amino acid sequence of SEQ ID NO:128, and a VH CDR3 having an amino acid sequence of SEQ ID NO:129; and (ii) a VL comprising a VL CDR1 having an amino acid sequence of SEQ ID NO:130, a VL CDR2 having an amino acid sequence of SEQ ID NO:131, and a VL CDR3 having an amino acid sequence of SEQ ID NO:132. In another aspect, provided herein is an antibody that binds Vβ17, comprising: (i) a VH comprising a VH CDR1 having an amino acid sequence of SEQ ID NO:133, a VH CDR2 having an amino acid sequence of SEQ ID NO:134, and a VH CDR3 having an amino acid sequence of SEQ ID NO:135; and (ii) a VL comprising a VL CDR1 having an amino acid sequence of SEQ ID NO:136, a VL CDR2 having an amino acid sequence of SEQ ID NO:137, and a VL CDR3 having an amino acid sequence of SEQ ID NO:138. In another aspect, provided herein is an antibody that binds Vβ17, comprising: a VH comprising a VH CDR1, a VH CDR2, and a VH CDR3 having an amino acid sequence of a VH CDR1, VH CDR2, and VH CDR3, respectively, of SEQ ID NO:25. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:26. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:7. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:8. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:9. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:10. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:25; and (ii) a VL comprising a VL CDR1, a VL CDR2, and a VL CDR3 having an amino acid sequence of a VL CDR1, VL CDR2, and VL CDR3, respectively, of SEQ ID NO:26. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:7; and (ii) a VL comprising a VL CDR1, a VL CDR2, and a VL CDR3 having an amino acid sequence of a VL CDR1, VL CDR2, and VL CDR3, respectively, of SEQ ID NO:8. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:9; and (ii) a VL comprising a VL CDR1, a VL CDR2, and a VL CDR3 having an amino acid sequence of a VL CDR1, VL CDR2, and VL CDR3, respectively, of SEQ ID NO:10. In some embodiments, the antibody comprises a VH having an amino acid sequence of SEQ ID NO:25. In some embodiments, the antibody comprises a VL having an amino acid sequence of SEQ ID NO:26. In some embodiments, the antibody comprises a VH having an amino acid sequence of SEQ ID NO:25, and a VL having an amino acid sequence of SEQ ID NO:26. In some embodiments, the antibody comprises a heavy chain having an amino acid sequence of SEQ ID NO:7. In some embodiments, the antibody comprises a light chain having an amino acid sequence of SEQ ID NO:8. In some embodiments, the antibody comprises a heavy chain having an amino acid sequence of SEQ ID NO:7, and a light chain having an amino acid sequence of SEQ ID NO:8. In some embodiments, the antibody comprises a heavy chain having an amino acid sequence of SEQ ID NO:9. In some embodiments, the antibody comprises a light chain having an amino acid sequence of SEQ ID NO:10. In some embodiments, the antibody comprises a heavy chain having an amino acid sequence of SEQ ID NO:9, and a light chain having an amino acid sequence of SEQ ID NO:10. In some embodiments, the antibody comprises a VH having an amino acid sequence having at least 95% identity to an amino acid sequence of SEQ ID NO:25. In some embodiments, the antibody comprises a VL having an amino acid sequence having at least 95% identity to an amino acid sequence of SEQ ID NO:26. In some embodiments, the antibody comprises a VH having an amino acid sequence having at least 95% identity to an amino acid sequence of SEQ ID NO:25, and a VL having an amino acid sequence having at least 95% identity to an amino acid sequence of SEQ ID NO:26. In some embodiments, the antibody comprises a heavy chain having an amino acid sequence having at least 95% identity to an amino acid sequence of SEQ ID NO:7. In some embodiments, the antibody comprises a light chain having an amino acid sequence having at least 95% identity to an amino acid sequence of SEQ ID NO:8. In some embodiments, the antibody comprises a heavy chain having an amino acid sequence having at least 95% identity to an amino acid sequence of SEQ ID NO:7, and a light chain having an amino acid sequence having at least 95% identity to an amino acid sequence of SEQ ID NO:8. In some embodiments, the antibody comprises a heavy chain having an amino acid sequence having at least 95% identity to an amino acid sequence of SEQ ID NO:9. In some embodiments, the antibody comprises a light chain having an amino acid sequence having at least 95% identity to an amino acid sequence of SEQ ID NO:10. In some embodiments, the antibody comprises a heavy chain having an amino acid sequence having at least 95% identity to an amino acid sequence of SEQ ID NO:9, and a light chain having an amino acid sequence having at least 95% identity to an amino acid sequence of SEQ ID NO:10.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:139, a VH CDR2 having an amino acid sequence of SEQ ID NO:140, and a VH CDR3 having an amino acid sequence of SEQ ID NO:141; and (ii) a VL comprising a VL CDR1 having an amino acid sequence of SEQ ID NO:142, a VL CDR2 having an amino acid sequence of SEQ ID NO:143, and a VL CDR3 having an amino acid sequence of SEQ ID NO:144. In another aspect, provided herein is an antibody that binds Vβ17, comprising: (i) a VH comprising a VH CDR1 having an amino acid sequence of SEQ ID NO:145, a VH CDR2 having an amino acid sequence of SEQ ID NO:146, and a VH CDR3 having an amino acid sequence of SEQ ID NO:147; and (ii) a VL comprising a VL CDR1 having an amino acid sequence of SEQ ID NO:148, a VL CDR2 having an amino acid sequence of SEQ ID NO:149, and a VL CDR3 having an amino acid sequence of SEQ ID NO:150. In another aspect, provided herein is an antibody that binds Vβ17, comprising: (i) a VH comprising a VH CDR1 having an amino acid sequence of SEQ ID NO:151, a VH CDR2 having an amino acid sequence of SEQ ID NO:152, and a VH CDR3 having an amino acid sequence of SEQ ID NO:153; and (ii) a VL comprising a VL CDR1 having an amino acid sequence of SEQ ID NO:154, a VL CDR2 having an amino acid sequence of SEQ ID NO:155, and a VL CDR3 having an amino acid sequence of SEQ ID NO:156. In another aspect, provided herein is an antibody that binds Vβ17, comprising: (i) a VH comprising a VH CDR1 having an amino acid sequence of SEQ ID NO:157, a VH CDR2 having an amino acid sequence of SEQ ID NO:158, and a VH CDR3 having an amino acid sequence of SEQ ID NO:159; and (ii) a VL comprising a VL CDR1 having an amino acid sequence of SEQ ID NO:160, a VL CDR2 having an amino acid sequence of SEQ ID NO:161, and a VL CDR3 having an amino acid sequence of SEQ ID NO:162. In another aspect, provided herein is an antibody that binds Vβ17, comprising: (i) a VH comprising a VH CDR1 having an amino acid sequence of SEQ ID NO:163, a VH CDR2 having an amino acid sequence of SEQ ID NO:164, and a VH CDR3 having an amino acid sequence of SEQ ID NO:165; and (ii) a VL comprising a VL CDR1 having an amino acid sequence of SEQ ID NO:166, a VL CDR2 having an amino acid sequence of SEQ ID NO:167, and a VL CDR3 having an amino acid sequence of SEQ ID NO:168. In another aspect, provided herein is an antibody that binds Vβ17, comprising: (i) a VH comprising a VH CDR1 having an amino acid sequence of SEQ ID NO:169, a VH CDR2 having an amino acid sequence of SEQ ID NO:170, and a VH CDR3 having an amino acid sequence of SEQ ID NO:171; and (ii) a VL comprising a VL CDR1 having an amino acid sequence of SEQ ID NO:172, a VL CDR2 having an amino acid sequence of SEQ ID NO:173, and a VL CDR3 having an amino acid sequence of SEQ ID NO:174. In another aspect, provided herein is an antibody that binds Vβ17, comprising: (i) a VH comprising a VH CDR1 having an amino acid sequence of SEQ ID NO:175, a VH CDR2 having an amino acid sequence of SEQ ID NO:176, and a VH CDR3 having an amino acid sequence of SEQ ID NO:177; and (ii) a VL comprising a VL CDR1 having an amino acid sequence of SEQ ID NO:178, a VL CDR2 having an amino acid sequence of SEQ ID NO:179, and a VL CDR3 having an amino acid sequence of SEQ ID NO:180. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:19. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:22. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:22. In some embodiments, the antibody comprises a VH having an amino acid sequence of SEQ ID NO:19. In some embodiments, the antibody comprises a VL having an amino acid sequence of SEQ ID NO:22. In some embodiments, the antibody comprises a VH having an amino acid sequence of SEQ ID NO:19, and a VL having an amino acid sequence of SEQ ID NO:22. In some embodiments, the antibody comprises a VH having an amino acid sequence having at least 95% identity to an amino acid sequence of SEQ ID NO:19. In some embodiments, the antibody comprises a VL having an amino acid sequence having at least 95% identity to an amino acid sequence of SEQ ID NO:22. In some embodiments, the antibody comprises a VH having an amino acid sequence having at least 95% identity to an amino acid sequence of SEQ ID NO:19, and a VL having an amino acid sequence having at least 95% identity to an amino acid sequence of SEQ ID NO:22.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:139, a VH CDR2 having an amino acid sequence of SEQ ID NO:140, and a VH CDR3 having an amino acid sequence of SEQ ID NO:141; and (ii) a VL comprising a VL CDR1 having an amino acid sequence of SEQ ID NO:184, a VL CDR2 having an amino acid sequence of SEQ ID NO:185, and a VL CDR3 having an amino acid sequence of SEQ ID NO:186. In another aspect, provided herein is an antibody that binds Vβ17, comprising: (i) a VH comprising a VH CDR1 having an amino acid sequence of SEQ ID NO:145, a VH CDR2 having an amino acid sequence of SEQ ID NO:146, and a VH CDR3 having an amino acid sequence of SEQ ID NO:147; and (ii) a VL comprising a VL CDR1 having an amino acid sequence of SEQ ID NO:190, a VL CDR2 having an amino acid sequence of SEQ ID NO:191, and a VL CDR3 having an amino acid sequence of SEQ ID NO:192. In another aspect, provided herein is an antibody that binds Vβ17, comprising: (i) a VH comprising a VH CDR1 having an amino acid sequence of SEQ ID NO:151, a VH CDR2 having an amino acid sequence of SEQ ID NO:152, and a VH CDR3 having an amino acid sequence of SEQ ID NO:153; and (ii) a VL comprising a VL CDR1 having an amino acid sequence of SEQ ID NO:196, a VL CDR2 having an amino acid sequence of SEQ ID NO:197, and a VL CDR3 having an amino acid sequence of SEQ ID NO:198. In another aspect, provided herein is an antibody that binds Vβ17, comprising: (i) a VH comprising a VH CDR1 having an amino acid sequence of SEQ ID NO:157, a VH CDR2 having an amino acid sequence of SEQ ID NO:158, and a VH CDR3 having an amino acid sequence of SEQ ID NO:159; and (ii) a VL comprising a VL CDR1 having an amino acid sequence of SEQ ID NO:202, a VL CDR2 having an amino acid sequence of SEQ ID NO:203, and a VL CDR3 having an amino acid sequence of SEQ ID NO:204. In another aspect, provided herein is an antibody that binds Vβ17, comprising: (i) a VH comprising a VH CDR1 having an amino acid sequence of SEQ ID NO:163, a VH CDR2 having an amino acid sequence of SEQ ID NO:164, and a VH CDR3 having an amino acid sequence of SEQ ID NO:165; and (ii) a VL comprising a VL CDR1 having an amino acid sequence of SEQ ID NO:208, a VL CDR2 having an amino acid sequence of SEQ ID NO:209, and a VL CDR3 having an amino acid sequence of SEQ ID NO:210. In another aspect, provided herein is an antibody that binds Vβ17, comprising: (i) a VH comprising a VH CDR1 having an amino acid sequence of SEQ ID NO:169, a VH CDR2 having an amino acid sequence of SEQ ID NO:170, and a VH CDR3 having an amino acid sequence of SEQ ID NO:171; and (ii) a VL comprising a VL CDR1 having an amino acid sequence of SEQ ID NO:214, a VL CDR2 having an amino acid sequence of SEQ ID NO:215, and a VL CDR3 having an amino acid sequence of SEQ ID NO:216. In another aspect, provided herein is an antibody that binds Vβ17, comprising: (i) a VH comprising a VH CDR1 having an amino acid sequence of SEQ ID NO:175, a VH CDR2 having an amino acid sequence of SEQ ID NO:176, and a VH CDR3 having an amino acid sequence of SEQ ID NO:177; and (ii) a VL comprising a VL CDR1 having an amino acid sequence of SEQ ID NO:220, a VL CDR2 having an amino acid sequence of SEQ ID NO:221, and a VL CDR3 having an amino acid sequence of SEQ ID NO:222. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:19. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:23. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:23. In some embodiments, the antibody comprises a VH having an amino acid sequence of SEQ ID NO:19. In some embodiments, the antibody comprises a VL having an amino acid sequence of SEQ ID NO:23. In some embodiments, the antibody comprises a VH having an amino acid sequence of SEQ ID NO:19, and a VL having an amino acid sequence of SEQ ID NO:23. In some embodiments, the antibody comprises a VH having an amino acid sequence having at least 95% identity to an amino acid sequence of SEQ ID NO:19. In some embodiments, the antibody comprises a VL having an amino acid sequence having at least 95% identity to an amino acid sequence of SEQ ID NO:23. In some embodiments, the antibody comprises a VH having an amino acid sequence having at least 95% identity to an amino acid sequence of SEQ ID NO:19, and a VL having an amino acid sequence having at least 95% identity to an amino acid sequence of SEQ ID NO:23.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:139, a VH CDR2 having an amino acid sequence of SEQ ID NO:140, and a VH CDR3 having an amino acid sequence of SEQ ID NO:141; and (ii) a VL comprising a VL CDR1 having an amino acid sequence of SEQ ID NO:226, a VL CDR2 having an amino acid sequence of SEQ ID NO:227, and a VL CDR3 having an amino acid sequence of SEQ ID NO:228. In another aspect, provided herein is an antibody that binds Vβ17, comprising: (i) a VH comprising a VH CDR1 having an amino acid sequence of SEQ ID NO:145, a VH CDR2 having an amino acid sequence of SEQ ID NO:146, and a VH CDR3 having an amino acid sequence of SEQ ID NO:147; and (ii) a VL comprising a VL CDR1 having an amino acid sequence of SEQ ID NO:232, a VL CDR2 having an amino acid sequence of SEQ ID NO:233, and a VL CDR3 having an amino acid sequence of SEQ ID NO:234. In another aspect, provided herein is an antibody that binds Vβ17, comprising: (i) a VH comprising a VH CDR1 having an amino acid sequence of SEQ ID NO:151, a VH CDR2 having an amino acid sequence of SEQ ID NO:152, and a VH CDR3 having an amino acid sequence of SEQ ID NO:153; and (ii) a VL comprising a VL CDR1 having an amino acid sequence of SEQ ID NO:238, a VL CDR2 having an amino acid sequence of SEQ ID NO:239, and a VL CDR3 having an amino acid sequence of SEQ ID NO:240. In another aspect, provided herein is an antibody that binds Vβ17, comprising: (i) a VH comprising a VH CDR1 having an amino acid sequence of SEQ ID NO:157, a VH CDR2 having an amino acid sequence of SEQ ID NO:158, and a VH CDR3 having an amino acid sequence of SEQ ID NO:159; and (ii) a VL comprising a VL CDR1 having an amino acid sequence of SEQ ID NO:244, a VL CDR2 having an amino acid sequence of SEQ ID NO:245, and a VL CDR3 having an amino acid sequence of SEQ ID NO:246. In another aspect, provided herein is an antibody that binds Vβ17, comprising: (i) a VH comprising a VH CDR1 having an amino acid sequence of SEQ ID NO:163, a VH CDR2 having an amino acid sequence of SEQ ID NO:164, and a VH CDR3 having an amino acid sequence of SEQ ID NO:165; and (ii) a VL comprising a VL CDR1 having an amino acid sequence of SEQ ID NO:250, a VL CDR2 having an amino acid sequence of SEQ ID NO:251, and a VL CDR3 having an amino acid sequence of SEQ ID NO:252. In another aspect, provided herein is an antibody that binds Vβ17, comprising: (i) a VH comprising a VH CDR1 having an amino acid sequence of SEQ ID NO:169, a VH CDR2 having an amino acid sequence of SEQ ID NO:170, and a VH CDR3 having an amino acid sequence of SEQ ID NO:171; and (ii) a VL comprising a VL CDR1 having an amino acid sequence of SEQ ID NO:256, a VL CDR2 having an amino acid sequence of SEQ ID NO:257, and a VL CDR3 having an amino acid sequence of SEQ ID NO:258. In another aspect, provided herein is an antibody that binds Vβ17, comprising: (i) a VH comprising a VH CDR1 having an amino acid sequence of SEQ ID NO:175, a VH CDR2 having an amino acid sequence of SEQ ID NO:176, and a VH CDR3 having an amino acid sequence of SEQ ID NO:177; and (ii) a VL comprising a VL CDR1 having an amino acid sequence of SEQ ID NO:262, a VL CDR2 having an amino acid sequence of SEQ ID NO:263, and a VL CDR3 having an amino acid sequence of SEQ ID NO:264. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:19. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:24. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:24. In some embodiments, the antibody comprises a VH having an amino acid sequence of SEQ ID NO:19. In some embodiments, the antibody comprises a VL having an amino acid sequence of SEQ ID NO:24. In some embodiments, the antibody comprises a VH having an amino acid sequence of SEQ ID NO:19, and a VL having a n amino acid sequence of SEQ ID NO:24. In some embodiments, the antibody comprises a VH having an amino acid sequence having at least 95% identity to an amino acid sequence of SEQ ID NO:19. In some embodiments, the antibody comprises a VL having an amino acid sequence having at least 95% identity to an amino acid sequence of SEQ ID NO:24. In some embodiments, the antibody comprises a VH having an amino acid sequence having at least 95% identity to an amino acid sequence of SEQ ID NO:19, and a VL having a n amino acid sequence of SEQ ID NO:24.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:181, a VH CDR2 having an amino acid sequence of SEQ ID NO:182, and a VH CDR3 having an amino acid sequence of SEQ ID NO:183; and (ii) a VL comprising a VL CDR1 having an amino acid sequence of SEQ ID NO:142, a VL CDR2 having an amino acid sequence of SEQ ID NO:143, and a VL CDR3 having an amino acid sequence of SEQ ID NO:144. In another aspect, provided herein is an antibody that binds Vβ17, comprising: (i) a VH comprising a VH CDR1 having an amino acid sequence of SEQ ID NO:187, a VH CDR2 having an amino acid sequence of SEQ ID NO:188, and a VH CDR3 having an amino acid sequence of SEQ ID NO:189; and (ii) a VL comprising a VL CDR1 having an amino acid sequence of SEQ ID NO:148, a VL CDR2 having an amino acid sequence of SEQ ID NO:149, and a VL CDR3 having an amino acid sequence of SEQ ID NO:150. In another aspect, provided herein is an antibody that binds Vβ17, comprising: (i) a VH comprising a VH CDR1 having an amino acid sequence of SEQ ID NO:193, a VH CDR2 having an amino acid sequence of SEQ ID NO:194, and a VH CDR3 having an amino acid sequence of SEQ ID NO:195; and (ii) a VL comprising a VL CDR1 having an amino acid sequence of SEQ ID NO:154, a VL CDR2 having an amino acid sequence of SEQ ID NO:155, and a VL CDR3 having an amino acid sequence of SEQ ID NO:156. In another aspect, provided herein is an antibody that binds Vβ17, comprising: (i) a VH comprising a VH CDR1 having an amino acid sequence of SEQ ID NO:199, a VH CDR2 having an amino acid sequence of SEQ ID NO:200, and a VH CDR3 having an amino acid sequence of SEQ ID NO:201; and (ii) a VL comprising a VL CDR1 having an amino acid sequence of SEQ ID NO:160, a VL CDR2 having an amino acid sequence of SEQ ID NO:161, and a VL CDR3 having an amino acid sequence of SEQ ID NO:162. In another aspect, provided herein is an antibody that binds Vβ17, comprising: (i) a VH comprising a VH CDR1 having an amino acid sequence of SEQ ID NO:205, a VH CDR2 having an amino acid sequence of SEQ ID NO:206, and a VH CDR3 having an amino acid sequence of SEQ ID NO:207; and (ii) a VL comprising a VL CDR1 having an amino acid sequence of SEQ ID NO:166, a VL CDR2 having an amino acid sequence of SEQ ID NO:167, and a VL CDR3 having an amino acid sequence of SEQ ID NO:168. In another aspect, provided herein is an antibody that binds Vβ17, comprising: (i) a VH comprising a VH CDR1 having an amino acid sequence of SEQ ID NO:211, a VH CDR2 having an amino acid sequence of SEQ ID NO:212, and a VH CDR3 having an amino acid sequence of SEQ ID NO:213; and (ii) a VL comprising a VL CDR1 having an amino acid sequence of SEQ ID NO:172, a VL CDR2 having an amino acid sequence of SEQ ID NO:173, and a VL CDR3 having an amino acid sequence of SEQ ID NO:174. In another aspect, provided herein is an antibody that binds Vβ17, comprising: (i) a VH comprising a VH CDR1 having an amino acid sequence of SEQ ID NO:217, a VH CDR2 having an amino acid sequence of SEQ ID NO:218, and a VH CDR3 having an amino acid sequence of SEQ ID NO:219 and (ii) a VL comprising a VL CDR1 having an amino acid sequence of SEQ ID NO:178, a VL CDR2 having an amino acid sequence of SEQ ID NO:179, and a VL CDR3 having an amino acid sequence of SEQ ID NO:180. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:20. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:22. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:20; and (ii) a VL comprising a VL CDR1, a VL CDR2, and a VL CDR3 having an amino acid sequence of a VL CDR1, VL CDR2, and VL CDR3, respectively, of SEQ ID NO:22. In some embodiments, the antibody comprises a VH having an amino acid sequence of SEQ ID NO:20. In some embodiments, the antibody comprises a VL having an amino acid sequence of SEQ ID NO:22. In some embodiments, the antibody comprises a VH having an amino acid sequence of SEQ ID NO:20, and a VL having an amino acid sequence of SEQ ID NO:22. In some embodiments, the antibody comprises a VH having an amino acid sequence having at least 95% identity to an amino acid sequence of SEQ ID NO:20. In some embodiments, the antibody comprises a VL having an amino acid sequence having at least 95% identity to an amino acid sequence of SEQ ID NO:22. In some embodiments, the antibody comprises a VH having an amino acid sequence having at least 95% identity to an amino acid sequence of SEQ ID NO:20, and a VL having an amino acid sequence having at least 95% identity to an amino acid sequence of SEQ ID NO:22.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:181, a VH CDR2 having an amino acid sequence of SEQ ID NO:182, and a VH CDR3 having an amino acid sequence of SEQ ID NO:183; and (ii) a VL comprising a VL CDR1 having an amino acid sequence of SEQ ID NO:184, a VL CDR2 having an amino acid sequence of SEQ ID NO:185, and a VL CDR3 having an amino acid sequence of SEQ ID NO:186. In another aspect, provided herein is an antibody that binds Vβ17, comprising: (i) a VH comprising a VH CDR1 having an amino acid sequence of SEQ ID NO:187, a VH CDR2 having an amino acid sequence of SEQ ID NO:188, and a VH CDR3 having an amino acid sequence of SEQ ID NO:189; and (ii) a VL comprising a VL CDR1 having an amino acid sequence of SEQ ID NO:190, a VL CDR2 having an amino acid sequence of SEQ ID NO:191, and a VL CDR3 having an amino acid sequence of SEQ ID NO:192. In another aspect, provided herein is an antibody that binds Vβ17, comprising: (i) a VH comprising a VH CDR1 having an amino acid sequence of SEQ ID NO:193, a VH CDR2 having an amino acid sequence of SEQ ID NO:194, and a VH CDR3 having an amino acid sequence of SEQ ID NO:195; and (ii) a VL comprising a VL CDR1 having an amino acid sequence of SEQ ID NO:196, a VL CDR2 having an amino acid sequence of SEQ ID NO:197, and a VL CDR3 having an amino acid sequence of SEQ ID NO:198. In another aspect, provided herein is an antibody that binds Vβ17, comprising: (i) a VH comprising a VH CDR1 having an amino acid sequence of SEQ ID NO:199, a VH CDR2 having an amino acid sequence of SEQ ID NO:200, and a VH CDR3 having an amino acid sequence of SEQ ID NO:201; and (ii) a VL comprising a VL CDR1 having an amino acid sequence of SEQ ID NO:202, a VL CDR2 having an amino acid sequence of SEQ ID NO:203, and a VL CDR3 having an amino acid sequence of SEQ ID NO:204. In another aspect, provided herein is an antibody that binds Vβ17, comprising: (i) a VH comprising a VH CDR1 having an amino acid sequence of SEQ ID NO:205, a VH CDR2 having an amino acid sequence of SEQ ID NO:206, and a VH CDR3 having an amino acid sequence of SEQ ID NO:207; and (ii) a VL comprising a VL CDR1 having an amino acid sequence of SEQ ID NO:208, a VL CDR2 having an amino acid sequence of SEQ ID NO:209, and a VL CDR3 having an amino acid sequence of SEQ ID NO:210. In another aspect, provided herein is an antibody that binds Vβ17, comprising: (i) a VH comprising a VH CDR1 having an amino acid sequence of SEQ ID NO:211, a VH CDR2 having an amino acid sequence of SEQ ID NO:212, and a VH CDR3 having an amino acid sequence of SEQ ID NO:213; and (ii) a VL comprising a VL CDR1 having an amino acid sequence of SEQ ID NO:214, a VL CDR2 having an amino acid sequence of SEQ ID NO:215, and a VL CDR3 having an amino acid sequence of SEQ ID NO:216. In another aspect, provided herein is an antibody that binds Vβ17, comprising: (i) a VH comprising a VH CDR1 having an amino acid sequence of SEQ ID NO:217, a VH CDR2 having an amino acid sequence of SEQ ID NO:218, and a VH CDR3 having an amino acid sequence of SEQ ID NO:219; and (ii) a VL comprising a VL CDR1 having an amino acid sequence of SEQ ID NO:220, a VL CDR2 having an amino acid sequence of SEQ ID NO:221, and a VL CDR3 having an amino acid sequence of SEQ ID NO:222. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:20. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:23. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:20; and (ii) a VL comprising a VL CDR1, a VL CDR2, and a VL CDR3 having an amino acid sequence of a VL CDR1, VL CDR2, and VL CDR3, respectively, of SEQ ID NO:23. In some embodiments, the antibody comprises a VH having an amino acid sequence of SEQ ID NO:20. In some embodiments, the antibody comprises a VL having an amino acid sequence of SEQ ID NO:23. In some embodiments, the antibody comprises a VH having an amino acid sequence of SEQ ID NO:20, and a VL having an amino acid sequence of SEQ ID NO:23. In some embodiments, the antibody comprises a VH having an amino acid sequence having at least 95% identity to an amino acid sequence of SEQ ID NO:20. In some embodiments, the antibody comprises a VL having an amino acid sequence having at least 95% identity to an amino acid sequence of SEQ ID NO:23. In some embodiments, the antibody comprises a VH having an amino acid sequence having at least 95% identity to an amino acid sequence of SEQ ID NO:20, and a VL having an amino acid sequence having at least 95% identity to an amino acid sequence of SEQ ID NO:23.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3 and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:181, a VH CDR2 having an amino acid sequence of SEQ ID NO:182, and a VH CDR3 having an amino acid sequence of SEQ ID NO:183; and (ii) a VL comprising a VL CDR1 having an amino acid sequence of SEQ ID NO:226, a VL CDR2 having an amino acid sequence of SEQ ID NO:227, and a VL CDR3 having an amino acid sequence of SEQ ID NO:228. In another aspect, provided herein is an antibody that binds Vβ17, comprising: (i) a VH comprising a VH CDR1 having an amino acid sequence of SEQ ID NO:187, a VH CDR2 having an amino acid sequence of SEQ ID NO:188, and a VH CDR3 having an amino acid sequence of SEQ ID NO:189; and (ii) a VL comprising a VL CDR1 having an amino acid sequence of SEQ ID NO:232, a VL CDR2 having an amino acid sequence of SEQ ID NO:233, and a VL CDR3 having an amino acid sequence of SEQ ID NO:234. In another aspect, provided herein is an antibody that binds Vβ17, comprising: (i) a VH comprising a VH CDR1 having an amino acid sequence of SEQ ID NO:193, a VH CDR2 having an amino acid sequence of SEQ ID NO:194, and a VH CDR3 having an amino acid sequence of SEQ ID NO:195; and (ii) a VL comprising a VL CDR1 having an amino acid sequence of SEQ ID NO:238, a VL CDR2 having an amino acid sequence of SEQ ID NO:239, and a VL CDR3 having an amino acid sequence of SEQ ID NO:240. In another aspect, provided herein is an antibody that binds Vβ17, comprising: (i) a VH comprising a VH CDR1 having an amino acid sequence of SEQ ID NO:199, a VH CDR2 having an amino acid sequence of SEQ ID NO:200, and a VH CDR3 having an amino acid sequence of SEQ ID NO:201; and (ii) a VL comprising a VL CDR1 having an amino acid sequence of SEQ ID NO:244, a VL CDR2 having an amino acid sequence of SEQ ID NO:245, and a VL CDR3 having an amino acid sequence of SEQ ID NO:246. In another aspect, provided herein is an antibody that binds Vβ17, comprising: (i) a VH comprising a VH CDR1 having an amino acid sequence of SEQ ID NO:205, a VH CDR2 having an amino acid sequence of SEQ ID NO:206, and a VH CDR3 having an amino acid sequence of SEQ ID NO:207; and (ii) a VL comprising a VL CDR1 having an amino acid sequence of SEQ ID NO:250, a VL CDR2 having an amino acid sequence of SEQ ID NO:251, and a VL CDR3 having an amino acid sequence of SEQ ID NO:252. In another aspect, provided herein is an antibody that binds Vβ17, comprising: (i) a VH comprising a VH CDR1 having an amino acid sequence of SEQ ID NO:211, a VH CDR2 having an amino acid sequence of SEQ ID NO:212, and a VH CDR3 having an amino acid sequence of SEQ ID NO:213; and (ii) a VL comprising a VL CDR1 having an amino acid sequence of SEQ ID NO:256, a VL CDR2 having an amino acid sequence of SEQ ID NO:257, and a VL CDR3 having an amino acid sequence of SEQ ID NO:258. In another aspect, provided herein is an antibody that binds Vβ17, comprising: (i) a VH comprising a VH CDR1 having an amino acid sequence of SEQ ID NO:217, a VH CDR2 having an amino acid sequence of SEQ ID NO:218, and a VH CDR3 having an amino acid sequence of SEQ ID NO:219; and (ii) a VL comprising a VL CDR1 having an amino acid sequence of SEQ ID NO:262, a VL CDR2 having an amino acid sequence of SEQ ID NO:263, and a VL CDR3 having an amino acid sequence of SEQ ID NO:264. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:20. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:24. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:20; and (ii) a VL comprising a VL CDR1, a VL CDR2, and a VL CDR3 having an amino acid sequence of a VL CDR1, VL CDR2, and VL CDR3, respectively, of SEQ ID NO:24. In some embodiments, the antibody comprises a VH having an amino acid sequence of SEQ ID NO:20. In some embodiments, the antibody comprises a VL having an amino acid sequence of SEQ ID NO:24. In some embodiments, the antibody comprises a VH having an amino acid sequence of SEQ ID NO:20, and a VL having an amino acid sequence of SEQ ID NO:24. In some embodiments, the antibody comprises a VH having an amino acid sequence having at least 95% identity to an amino acid sequence of SEQ ID NO:20. In some embodiments, the antibody comprises a VL having an amino acid sequence having at least 95% identity to an amino acid sequence of SEQ ID NO:24. In some embodiments, the antibody comprises a VH having an amino acid sequence having at least 95% identity to an amino acid sequence of SEQ ID NO:20, and a VL having an amino acid sequence having at least 95% identity to an amino acid sequence of SEQ ID NO:24.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:223, a VH CDR2 having an amino acid sequence of SEQ ID NO:224, and a VH CDR3 having an amino acid sequence of SEQ ID NO:225; and (ii) a VL comprising a VL CDR1 having an amino acid sequence of SEQ ID NO:142, a VL CDR2 having an amino acid sequence of SEQ ID NO:143, and a VL CDR3 having an amino acid sequence of SEQ ID NO:144. In another aspect, provided herein is an antibody that binds Vβ17, comprising: (i) a VH comprising a VH CDR1 having an amino acid sequence of SEQ ID NO:229, a VH CDR2 having an amino acid sequence of SEQ ID NO:230, and a VH CDR3 having an amino acid sequence of SEQ ID NO:231; and (ii) a VL comprising a VL CDR1 having an amino acid sequence of SEQ ID NO:148, a VL CDR2 having an amino acid sequence of SEQ ID NO:149, and a VL CDR3 having an amino acid sequence of SEQ ID NO:150. In another aspect, provided herein is an antibody that binds Vβ17, comprising: (i) a VH comprising a VH CDR1 having an amino acid sequence of SEQ ID NO:235, a VH CDR2 having an amino acid sequence of SEQ ID NO:236, and a VH CDR3 having an amino acid sequence of SEQ ID NO:237; and (ii) a VL comprising a VL CDR1 having an amino acid sequence of SEQ ID NO:154, a VL CDR2 having an amino acid sequence of SEQ ID NO:155, and a VL CDR3 having an amino acid sequence of SEQ ID NO:156. In another aspect, provided herein is an antibody that binds Vβ17, comprising: (i) a VH comprising a VH CDR1 having an amino acid sequence of SEQ ID NO:241, a VH CDR2 having an amino acid sequence of SEQ ID NO:242, and a VH CDR3 having an amino acid sequence of SEQ ID NO:243; and (ii) a VL comprising a VL CDR1 having an amino acid sequence of SEQ ID NO:160, a VL CDR2 having an amino acid sequence of SEQ ID NO:161, and a VL CDR3 having an amino acid sequence of SEQ ID NO:162. In another aspect, provided herein is an antibody that binds Vβ17, comprising: (i) a VH comprising a VH CDR1 having an amino acid sequence of SEQ ID NO:247, a VH CDR2 having an amino acid sequence of SEQ ID NO:248, and a VH CDR3 having an amino acid sequence of SEQ ID NO:249; and (ii) a VL comprising a VL CDR1 having an amino acid sequence of SEQ ID NO:166, a VL CDR2 having an amino acid sequence of SEQ ID NO:167, and a VL CDR3 having an amino acid sequence of SEQ ID NO:168. In another aspect, provided herein is an antibody that binds Vβ17, comprising: (i) a VH comprising a VH CDR1 having an amino acid sequence of SEQ ID NO:253, a VH CDR2 having an amino acid sequence of SEQ ID NO:254, and a VH CDR3 having an amino acid sequence of SEQ ID NO:255; and (ii) a VL comprising a VL CDR1 having an amino acid sequence of SEQ ID NO:172, a VL CDR2 having an amino acid sequence of SEQ ID NO:173, and a VL CDR3 having an amino acid sequence of SEQ ID NO:174. In another aspect, provided herein is an antibody that binds Vβ17, comprising: (i) a VH comprising a VH CDR1 having an amino acid sequence of SEQ ID NO:259, a VH CDR2 having an amino acid sequence of SEQ ID NO:260, and a VH CDR3 having an amino acid sequence of SEQ ID NO:261; and (ii) a VL comprising a VL CDR1 having an amino acid sequence of SEQ ID NO:178, a VL CDR2 having an amino acid sequence of SEQ ID NO:179, and a VL CDR3 having an amino acid sequence of SEQ ID NO:180. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:21. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:22. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:22. In some embodiments, the antibody comprises a VH having an amino acid sequence of SEQ ID NO:21. In some embodiments, the antibody comprises a VL having an amino acid sequence of SEQ ID NO:22. In some embodiments, the antibody comprises a VH having an amino acid sequence of SEQ ID NO:21, and a VL having an amino acid sequence of SEQ ID NO:22. In some embodiments, the antibody comprises a VH having an amino acid sequence having at least 95% identity to an amino acid sequence of SEQ ID NO:21. In some embodiments, the antibody comprises a VL having an amino acid sequence having at least 95% identity to an amino acid sequence of SEQ ID NO:22. In some embodiments, the antibody comprises a VH having an amino acid sequence having at least 95% identity to an amino acid sequence of SEQ ID NO:21, and a VL having an amino acid sequence having at least 95% identity to an amino acid sequence of SEQ ID NO:22.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:223, a VH CDR2 having an amino acid sequence of SEQ ID NO:224, and a VH CDR3 having an amino acid sequence of SEQ ID NO:225; and (ii) a VL comprising a VL CDR1 having an amino acid sequence of SEQ ID NO:184, a VL CDR2 having an amino acid sequence of SEQ ID NO:185, and a VL CDR3 having an amino acid sequence of SEQ ID NO:186. In another aspect, provided herein is an antibody that binds Vβ17, comprising: (i) a VH comprising a VH CDR1 having an amino acid sequence of SEQ ID NO:229, a VH CDR2 having an amino acid sequence of SEQ ID NO:230, and a VH CDR3 having an amino acid sequence of SEQ ID NO:231; and (ii) a VL comprising a VL CDR1 having an amino acid sequence of SEQ ID NO:190, a VL CDR2 having an amino acid sequence of SEQ ID NO:191, and a VL CDR3 having an amino acid sequence of SEQ ID NO:192. In another aspect, provided herein is an antibody that binds Vβ17, comprising: (i) a VH comprising a VH CDR1 having an amino acid sequence of SEQ ID NO:235, a VH CDR2 having an amino acid sequence of SEQ ID NO:236, and a VH CDR3 having an amino acid sequence of SEQ ID NO:237; and (ii) a VL comprising a VL CDR1 having an amino acid sequence of SEQ ID NO:196, a VL CDR2 having an amino acid sequence of SEQ ID NO:197, and a VL CDR3 having an amino acid sequence of SEQ ID NO:198. In another aspect, provided herein is an antibody that binds Vβ17, comprising: (i) a VH comprising a VH CDR1 having an amino acid sequence of SEQ ID NO:241, a VH CDR2 having an amino acid sequence of SEQ ID NO:242, and a VH CDR3 having an amino acid sequence of SEQ ID NO:243; and (ii) a VL comprising a VL CDR1 having an amino acid sequence of SEQ ID NO:202, a VL CDR2 having an amino acid sequence of SEQ ID NO:203, and a VL CDR3 having an amino acid sequence of SEQ ID NO:204. In another aspect, provided herein is an antibody that binds Vβ17, comprising: (i) a VH comprising a VH CDR1 having an amino acid sequence of SEQ ID NO:247, a VH CDR2 having an amino acid sequence of SEQ ID NO:248, and a VH CDR3 having an amino acid sequence of SEQ ID NO:249; and (ii) a VL comprising a VL CDR1 having an amino acid sequence of SEQ ID NO:208, a VL CDR2 having an amino acid sequence of SEQ ID NO:209, and a VL CDR3 having an amino acid sequence of SEQ ID NO:210. In another aspect, provided herein is an antibody that binds Vβ17, comprising: (i) a VH comprising a VH CDR1 having an amino acid sequence of SEQ ID NO:253, a VH CDR2 having an amino acid sequence of SEQ ID NO:254, and a VH CDR3 having an amino acid sequence of SEQ ID NO:255; and (ii) a VL comprising a VL CDR1 having an amino acid sequence of SEQ ID NO:214, a VL CDR2 having an amino acid sequence of SEQ ID NO:215, and a VL CDR3 having an amino acid sequence of SEQ ID NO:216. In another aspect, provided herein is an antibody that binds Vβ17, comprising: (i) a VH comprising a VH CDR1 having an amino acid sequence of SEQ ID NO:259, a VH CDR2 having an amino acid sequence of SEQ ID NO:260, and a VH CDR3 having an amino acid sequence of SEQ ID NO:261; and (ii) a VL comprising a VL CDR1 having an amino acid sequence of SEQ ID NO:220, a VL CDR2 having an amino acid sequence of SEQ ID NO:221, and a VL CDR3 having an amino acid sequence of SEQ ID NO:222. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:21. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:23. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:23. In some embodiments, the antibody comprises a VH having an amino acid sequence of SEQ ID NO:21. In some embodiments, the antibody comprises a VL having an amino acid sequence of SEQ ID NO:23. In some embodiments, the antibody comprises a VH having an amino acid sequence of SEQ ID NO:21, and a VL having an amino acid sequence of SEQ ID NO:23. In some embodiments, the antibody comprises a VH having an amino acid sequence having at least 95% identity to an amino acid sequence of SEQ ID NO:21. In some embodiments, the antibody comprises a VL having an amino acid sequence having at least 95% identity to an amino acid sequence of SEQ ID NO:23. In some embodiments, the antibody comprises a VH having an amino acid sequence having at least 95% identity to an amino acid sequence of SEQ ID NO:21, and a VL having an amino acid sequence having at least 95% identity to an amino acid sequence of SEQ ID NO:23.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:223, a VH CDR2 having an amino acid sequence of SEQ ID NO:224, and a VH CDR3 having an amino acid sequence of SEQ ID NO:225; and (ii) a VL comprising a VL CDR1 having an amino acid sequence of SEQ ID NO:226, a VL CDR2 having an amino acid sequence of SEQ ID NO:227, and a VL CDR3 having an amino acid sequence of SEQ ID NO:228. In another aspect, provided herein is an antibody that binds Vβ17, comprising: (i) a VH comprising a VH CDR1 having an amino acid sequence of SEQ ID NO:229, a VH CDR2 having an amino acid sequence of SEQ ID NO:230, and a VH CDR3 having an amino acid sequence of SEQ ID NO:231; and (ii) a VL comprising a VL CDR1 having an amino acid sequence of SEQ ID NO:232, a VL CDR2 having an amino acid sequence of SEQ ID NO:233, and a VL CDR3 having an amino acid sequence of SEQ ID NO:234. In another aspect, provided herein is an antibody that binds Vβ17, comprising: (i) a VH comprising a VH CDR1 having an amino acid sequence of SEQ ID NO:235, a VH CDR2 having an amino acid sequence of SEQ ID NO:236, and a VH CDR3 having an amino acid sequence of SEQ ID NO:237; and (ii) a VL comprising a VL CDR1 having an amino acid sequence of SEQ ID NO:238, a VL CDR2 having an amino acid sequence of SEQ ID NO:239, and a VL CDR3 having an amino acid sequence of SEQ ID NO:240. In another aspect, provided herein is an antibody that binds Vβ17, comprising: (i) a VH comprising a VH CDR1 having an amino acid sequence of SEQ ID NO:241, a VH CDR2 having an amino acid sequence of SEQ ID NO:242, and a VH CDR3 having an amino acid sequence of SEQ ID NO:243; and (ii) a VL comprising a VL CDR1 having an amino acid sequence of SEQ ID NO:244, a VL CDR2 having an amino acid sequence of SEQ ID NO:245, and a VL CDR3 having an amino acid sequence of SEQ ID NO:246. In another aspect, provided herein is an antibody that binds Vβ17, comprising: (i) a VH comprising a VH CDR1 having an amino acid sequence of SEQ ID NO:247, a VH CDR2 having an amino acid sequence of SEQ ID NO:248, and a VH CDR3 having an amino acid sequence of SEQ ID NO:249; and (ii) a VL comprising a VL CDR1 having an amino acid sequence of SEQ ID NO:250, a VL CDR2 having an amino acid sequence of SEQ ID NO:251, and a VL CDR3 having an amino acid sequence of SEQ ID NO:252. In another aspect, provided herein is an antibody that binds Vβ17, comprising: (i) a VH comprising a VH CDR1 having an amino acid sequence of SEQ ID NO:253, a VH CDR2 having an amino acid sequence of SEQ ID NO:254, and a VH CDR3 having an amino acid sequence of SEQ ID NO:255; and (ii) a VL comprising a VL CDR1 having an amino acid sequence of SEQ ID NO:256, a VL CDR2 having an amino acid sequence of SEQ ID NO:257, and a VL CDR3 having an amino acid sequence of SEQ ID NO:258. In another aspect, provided herein is an antibody that binds Vβ17, comprising: (i) a VH comprising a VH CDR1 having an amino acid sequence of SEQ ID NO:259, a VH CDR2 having an amino acid sequence of SEQ ID NO:260, and a VH CDR3 having an amino acid sequence of SEQ ID NO:261; and (ii) a VL comprising a VL CDR1 having an amino acid sequence of SEQ ID NO:262, a VL CDR2 having an amino acid sequence of SEQ ID NO:263, and a VL CDR3 having an amino acid sequence of SEQ ID NO:264. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:21. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:24. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:24. In some embodiments, the antibody comprises a VH having an amino acid sequence of SEQ ID NO:21. In some embodiments, the antibody comprises a VL having an amino acid sequence of SEQ ID NO:24. In some embodiments, the antibody comprises a VH having an amino acid sequence of SEQ ID NO:21, and a VL having an amino acid sequence of SEQ ID NO:24. In some embodiments, the antibody comprises a VH having an amino acid sequence having at least 95% identity to an amino acid sequence of SEQ ID NO:21. In some embodiments, the antibody comprises a VL having an amino acid sequence having at least 95% identity to an amino acid sequence of SEQ ID NO:24. In some embodiments, the antibody comprises a VH having an amino acid sequence having at least 95% identity to an amino acid sequence of SEQ ID NO:21, and a VL having an amino acid sequence having at least 95% identity to an amino acid sequence of SEQ ID NO:24.

In another aspect, provided herein is an antibody that binds Vβ17, comprising: (i) a VH comprising a VH CDR1 having an amino acid sequence of SEQ ID NO:45, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:4, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:265, a VH CDR2 having an amino acid sequence of SEQ ID NO:266, and a VH CDR3 having an amino acid sequence of SEQ ID NO:267; and (ii) a VL comprising a VL CDR1 having an amino acid sequence of SEQ ID NO:268, a VL CDR2 having an amino acid sequence of SEQ ID NO:269, and a VL CDR3 having an amino acid sequence of SEQ ID NO:270. In another aspect, provided herein is an antibody that binds Vβ17, comprising: (i) a VH comprising a VH CDR1 having an amino acid sequence of SEQ ID NO:271, a VH CDR2 having an amino acid sequence of SEQ ID NO:272, and a VH CDR3 having an amino acid sequence of SEQ ID NO:273; and (ii) a VL comprising a VL CDR1 having an amino acid sequence of SEQ ID NO:274, a VL CDR2 having an amino acid sequence of SEQ ID NO:275, and a VL CDR3 having an amino acid sequence of SEQ ID NO:276. In another aspect, provided herein is an antibody that binds Vβ17, comprising: (i) a VH comprising a VH CDR1 having an amino acid sequence of SEQ ID NO:277, a VH CDR2 having an amino acid sequence of SEQ ID NO:278, and a VH CDR3 having an amino acid sequence of SEQ ID NO:279; and (ii) a VL comprising a VL CDR1 having an amino acid sequence of SEQ ID NO:280, a VL CDR2 having an amino acid sequence of SEQ ID NO:281, and a VL CDR3 having an amino acid sequence of SEQ ID NO:282. In another aspect, provided herein is an antibody that binds Vβ17, comprising: (i) a VH comprising a VH CDR1 having an amino acid sequence of SEQ ID NO:283, a VH CDR2 having an amino acid sequence of SEQ ID NO:284, and a VH CDR3 having an amino acid sequence of SEQ ID NO:285; and (ii) a VL comprising a VL CDR1 having an amino acid sequence of SEQ ID NO:286, a VL CDR2 having an amino acid sequence of SEQ ID NO:287, and a VL CDR3 having an amino acid sequence of SEQ ID NO:288. In another aspect, provided herein is an antibody that binds Vβ17, comprising: (i) a VH comprising a VH CDR1 having an amino acid sequence of SEQ ID NO:289, a VH CDR2 having an amino acid sequence of SEQ ID NO:290, and a VH CDR3 having an amino acid sequence of SEQ ID NO:291; and (ii) a VL comprising a VL CDR1 having an amino acid sequence of SEQ ID NO:292, a VL CDR2 having an amino acid sequence of SEQ ID NO:293, and a VL CDR3 having an amino acid sequence of SEQ ID NO:294. In another aspect, provided herein is an antibody that binds Vβ17, comprising: (i) a VH comprising a VH CDR1 having an amino acid sequence of SEQ ID NO:295, a VH CDR2 having an amino acid sequence of SEQ ID NO:296, and a VH CDR3 having an amino acid sequence of SEQ ID NO:297; and (ii) a VL comprising a VL CDR1 having an amino acid sequence of SEQ ID NO:298, a VL CDR2 having an amino acid sequence of SEQ ID NO:299, and a VL CDR3 having an amino acid sequence of SEQ ID NO:300. In another aspect, provided herein is an antibody that binds Vβ17, comprising: (i) a VH comprising a VH CDR1 having an amino acid sequence of SEQ ID NO:301, a VH CDR2 having an amino acid sequence of SEQ ID NO:302, and a VH CDR3 having an amino acid sequence of SEQ ID NO:303; and (ii) a VL comprising a VL CDR1 having an amino acid sequence of SEQ ID NO:304, a VL CDR2 having an amino acid sequence of SEQ ID NO:305, and a VL CDR3 having an amino acid sequence of SEQ ID NO:306. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:46. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:49. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:46; and (ii) a VL comprising a VL CDR1, a VL CDR2, and a VL CDR3 having an amino acid sequence of a VL CDR1, VL CDR2, and VL CDR3, respectively, of SEQ ID NO:49. In some embodiments, the antibody comprises a VH having an amino acid sequence of SEQ ID NO:46. In some embodiments, the antibody comprises a VL having an amino acid sequence of SEQ ID NO:47. In some embodiments, the antibody comprises a VH having an amino acid sequence of SEQ ID NO:46, and a VL having an amino acid sequence of SEQ ID NO:47. In some embodiments, the antibody comprises a heavy chain having an amino acid sequence of SEQ ID NO:11. In some embodiments, the antibody comprises a light chain having an amino acid sequence of SEQ ID NO:12. In some embodiments, the antibody comprises a heavy chain having an amino acid sequence of SEQ ID NO:11, and a light chain having an amino acid sequence of SEQ ID NO:12. In some embodiments, the antibody comprises a VH having an amino acid sequence having at least 95% identity to an amino acid sequence of SEQ ID NO:46. In some embodiments, the antibody comprises a VL having an amino acid sequence having at least 95% identity to an amino acid sequence of SEQ ID NO:47. In some embodiments, the antibody comprises a VH having an amino acid sequence having at least 95% identity to an amino acid sequence of SEQ ID NO:46, and a VL having an amino acid sequence having at least 95% identity to an amino acid sequence of SEQ ID NO:47. In some embodiments, the antibody comprises a heavy chain having an amino acid sequence having at least 95% identity to an amino acid sequence of SEQ ID NO:11. In some embodiments, the antibody comprises a light chain having an amino acid sequence having at least 95% identity to an amino acid sequence of SEQ ID NO:12. In some embodiments, the antibody comprises a heavy chain having an amino acid sequence having at least 95% identity to an amino acid sequence of SEQ ID NO:11, and a light chain having an amino acid sequence having at least 95% identity to an amino acid sequence of SEQ ID NO:12.

In another aspect, provided herein is an antibody that binds Vβ17, comprising: (i) a VH comprising a VH CDR1 having an amino acid sequence of SEQ ID NO:48, a VH CDR2 having an amino acid sequence of SEQ ID NO:49, and a VH CDR3 having an amino acid sequence of SEQ ID NO:50; and (ii) a VL comprising a VL CDR1 having an amino acid sequence of SEQ ID NO:51, a VL CDR2 having an amino acid sequence of SEQ ID NO:52, and a VL CDR3 having an amino acid sequence of SEQ ID NO:53. In another aspect, provided herein is an antibody that binds Vβ17, comprising: (i) a VH comprising a VH CDR1 having an amino acid sequence of SEQ ID NO:307, a VH CDR2 having an amino acid sequence of SEQ ID NO:308, and a VH CDR3 having an amino acid sequence of SEQ ID NO:309; and (ii) a VL comprising a VL CDR1 having an amino acid sequence of SEQ ID NO:310, a VL CDR2 having an amino acid sequence of SEQ ID NO:311, and a VL CDR3 having an amino acid sequence of SEQ ID NO:312. In another aspect, provided herein is an antibody that binds Vβ17, comprising: (i) a VH comprising a VH CDR1 having an amino acid sequence of SEQ ID NO:313, a VH CDR2 having an amino acid sequence of SEQ ID NO:314, and a VH CDR3 having an amino acid sequence of SEQ ID NO:315; and (ii) a VL comprising a VL CDR1 having an amino acid sequence of SEQ ID NO:316, a VL CDR2 having an amino acid sequence of SEQ ID NO:317, and a VL CDR3 having an amino acid sequence of SEQ ID NO:318. In another aspect, provided herein is an antibody that binds Vβ17, comprising: (i) a VH comprising a VH CDR1 having an amino acid sequence of SEQ ID NO:319, a VH CDR2 having an amino acid sequence of SEQ ID NO:320, and a VH CDR3 having an amino acid sequence of SEQ ID NO:321; and (ii) a VL comprising a VL CDR1 having an amino acid sequence of SEQ ID NO:322, a VL CDR2 having an amino acid sequence of SEQ ID NO:323, and a VL CDR3 having an amino acid sequence of SEQ ID NO:324. In another aspect, provided herein is an antibody that binds Vβ17, comprising: (i) a VH comprising a VH CDR1 having an amino acid sequence of SEQ ID NO:325, a VH CDR2 having an amino acid sequence of SEQ ID NO:326, and a VH CDR3 having an amino acid sequence of SEQ ID NO:327; and (ii) a VL comprising a VL CDR1 having an amino acid sequence of SEQ ID NO:328, a VL CDR2 having an amino acid sequence of SEQ ID NO:329, and a VL CDR3 having an amino acid sequence of SEQ ID NO:330. In another aspect, provided herein is an antibody that binds Vβ17, comprising: (i) a VH comprising a VH CDR1 having an amino acid sequence of SEQ ID NO:331, a VH CDR2 having an amino acid sequence of SEQ ID NO:332, and a VH CDR3 having an amino acid sequence of SEQ ID NO:333; and (ii) a VL comprising a VL CDR1 having an amino acid sequence of SEQ ID NO:334, a VL CDR2 having an amino acid sequence of SEQ ID NO:335, and a VL CDR3 having an amino acid sequence of SEQ ID NO:336. In another aspect, provided herein is an antibody that binds Vβ17, comprising: (i) a VH comprising a VH CDR1 having an amino acid sequence of SEQ ID NO:337, a VH CDR2 having an amino acid sequence of SEQ ID NO:338, and a VH CDR3 having an amino acid sequence of SEQ ID NO:339; and (ii) a VL comprising a VL CDR1 having an amino acid sequence of SEQ ID NO:340, a VL CDR2 having an amino acid sequence of SEQ ID NO:341, and a VL CDR3 having an amino acid sequence of SEQ ID NO:342. In another aspect, provided herein is an antibody that binds Vβ17, comprising: (i) a VH comprising a VH CDR1 having an amino acid sequence of SEQ ID NO:343, a VH CDR2 having an amino acid sequence of SEQ ID NO:344, and a VH CDR3 having an amino acid sequence of SEQ ID NO:345; and (ii) a VL comprising a VL CDR1 having an amino acid sequence of SEQ ID NO:346, a VL CDR2 having an amino acid sequence of SEQ ID NO:347, and a VL CDR3 having an amino acid sequence of SEQ ID NO:348. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:77. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:78. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:77; and (ii) a VL comprising a VL CDR1, a VL CDR2, and a VL CDR3 having an amino acid sequence of a VL CDR1, VL CDR2, and VL CDR3, respectively, of SEQ ID NO:78. In some embodiments, the antibody comprises a VH having an amino acid sequence of SEQ ID NO:77. In some embodiments, the antibody comprises a VL having an amino acid sequence of SEQ ID NO:78. In some embodiments, the antibody comprises a VH having an amino acid sequence of SEQ ID NO:77, and a VL having an amino acid sequence of SEQ ID NO:78. In some embodiments, the antibody comprises a heavy chain having an amino acid sequence of SEQ ID NO:664. In some embodiments, the antibody comprises a light chain having an amino acid sequence of SEQ ID NO:665. In some embodiments, the antibody comprises a heavy chain having an amino acid sequence of SEQ ID NO:664, and a light chain having an amino acid sequence of SEQ ID NO:665. In some embodiments, the antibody comprises a VH having an amino acid sequence having at least 95% identity to an amino acid sequence of SEQ ID NO:77. In some embodiments, the antibody comprises a VL having an amino acid sequence having at least 95% identity to an amino acid sequence of SEQ ID NO:78. In some embodiments, the antibody comprises a VH having an amino acid sequence having at least 95% identity to an amino acid sequence of SEQ ID NO:77, and a VL having an amino acid sequence having at least 95% identity to an amino acid sequence of SEQ ID NO:78. In some embodiments, the antibody comprises a heavy chain having an amino acid sequence having at least 95% identity to an amino acid sequence of SEQ ID NO:664. In some embodiments, the antibody comprises a light chain having an amino acid sequence having at least 95% identity to an amino acid sequence of SEQ ID NO:665. In some embodiments, the antibody comprises a heavy chain having an amino acid sequence having at least 95% identity to an amino acid sequence of SEQ ID NO:664, and a light chain having an amino acid sequence having at least 95% identity to an amino acid sequence of SEQ ID NO:665.

In another aspect, provided herein is an antibody that binds Vβ17, comprising: (i) a VH comprising a VH CDR1 having an amino acid sequence of SEQ ID NO:48, a VH CDR2 having an amino acid sequence of SEQ ID NO:54, and a VH CDR3 having an amino acid sequence of SEQ ID NO:55; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:58. In another aspect, provided herein is an antibody that binds Vβ17, comprising: (i) a VH comprising a VH CDR1 having an amino acid sequence of SEQ ID NO:349, a VH CDR2 having an amino acid sequence of SEQ ID NO:350, and a VH CDR3 having an amino acid sequence of SEQ ID NO:351; and (ii) a VL comprising a VL CDR1 having an amino acid sequence of SEQ ID NO:352, a VL CDR2 having an amino acid sequence of SEQ ID NO:353, and a VL CDR3 having an amino acid sequence of SEQ ID NO:354. In another aspect, provided herein is an antibody that binds Vβ17, comprising: (i) a VH comprising a VH CDR1 having an amino acid sequence of SEQ ID NO:355, a VH CDR2 having an amino acid sequence of SEQ ID NO:356, and a VH CDR3 having an amino acid sequence of SEQ ID NO:357; and (ii) a VL comprising a VL CDR1 having an amino acid sequence of SEQ ID NO:358, a VL CDR2 having an amino acid sequence of SEQ ID NO:359, and a VL CDR3 having an amino acid sequence of SEQ ID NO:360. In another aspect, provided herein is an antibody that binds Vβ17, comprising: (i) a VH comprising a VH CDR1 having an amino acid sequence of SEQ ID NO:361, a VH CDR2 having an amino acid sequence of SEQ ID NO:362, and a VH CDR3 having an amino acid sequence of SEQ ID NO:363; and (ii) a VL comprising a VL CDR1 having an amino acid sequence of SEQ ID NO:364, a VL CDR2 having an amino acid sequence of SEQ ID NO:365, and a VL CDR3 having an amino acid sequence of SEQ ID NO:366. In another aspect, provided herein is an antibody that binds Vβ17, comprising: (i) a VH comprising a VH CDR1 having an amino acid sequence of SEQ ID NO:367, a VH CDR2 having an amino acid sequence of SEQ ID NO:368, and a VH CDR3 having an amino acid sequence of SEQ ID NO:369; and (ii) a VL comprising a VL CDR1 having an amino acid sequence of SEQ ID NO:370, a VL CDR2 having an amino acid sequence of SEQ ID NO:371, and a VL CDR3 having an amino acid sequence of SEQ ID NO:372. In another aspect, provided herein is an antibody that binds Vβ17, comprising: (i) a VH comprising a VH CDR1 having an amino acid sequence of SEQ ID NO:373, a VH CDR2 having an amino acid sequence of SEQ ID NO:374, and a VH CDR3 having an amino acid sequence of SEQ ID NO:375; and (ii) a VL comprising a VL CDR1 having an amino acid sequence of SEQ ID NO:376, a VL CDR2 having an amino acid sequence of SEQ ID NO:377, and a VL CDR3 having an amino acid sequence of SEQ ID NO:378. In another aspect, provided herein is an antibody that binds Vβ17, comprising: (i) a VH comprising a VH CDR1 having an amino acid sequence of SEQ ID NO:379, a VH CDR2 having an amino acid sequence of SEQ ID NO:380, and a VH CDR3 having an amino acid sequence of SEQ ID NO:381; and (ii) a VL comprising a VL CDR1 having an amino acid sequence of SEQ ID NO:382, a VL CDR2 having an amino acid sequence of SEQ ID NO:383, and a VL CDR3 having an amino acid sequence of SEQ ID NO:384. In another aspect, provided herein is an antibody that binds Vβ17, comprising: (i) a VH comprising a VH CDR1 having an amino acid sequence of SEQ ID NO:385, a VH CDR2 having an amino acid sequence of SEQ ID NO:386, and a VH CDR3 having an amino acid sequence of SEQ ID NO:387; and (ii) a VL comprising a VL CDR1 having an amino acid sequence of SEQ ID NO:388, a VL CDR2 having an amino acid sequence of SEQ ID NO:389, and a VL CDR3 having an amino acid sequence of SEQ ID NO:390. In another aspect, provided herein is an antibody that binds Vβ17, comprising: a VH comprising a VH CDR1, a VH CDR2, and a VH CDR3 having an amino acid sequence of a VH CDR1, VH CDR2, and VH CDR3, respectively, of SEQ ID NO:79. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:80. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:79; and (ii) a VL comprising a VL CDR1, a VL CDR2, and a VL CDR3 having an amino acid sequence of a VL CDR1, VL CDR2, and VL CDR3, respectively, of SEQ ID NO:80. In some embodiments, the antibody comprises a VH having an amino acid sequence of SEQ ID NO:79. In some embodiments, the antibody comprises a VL having an amino acid sequence of SEQ ID NO:80. In some embodiments, the antibody comprises a VH having an amino acid sequence of SEQ ID NO:79, and a VL having an amino acid sequence of SEQ ID NO:80. In some embodiments, the antibody comprises a heavy chain having an amino acid sequence of SEQ ID NO:666. In some embodiments, the antibody comprises a light chain having an amino acid sequence of SEQ ID NO:667. In some embodiments, the antibody comprises a heavy chain having an amino acid sequence of SEQ ID NO:666, and a light chain having an amino acid sequence of SEQ ID NO:667. In some embodiments, the antibody comprises a VH having an amino acid sequence having at least 95% identity to an amino acid sequence of SEQ ID NO:79. In some embodiments, the antibody comprises a VL having an amino acid sequence having at least 95% identity to an amino acid sequence of SEQ ID NO:80. In some embodiments, the antibody comprises a VH having an amino acid sequence having at least 95% identity to an amino acid sequence of SEQ ID NO:79, and a VL having an amino acid sequence having at least 95% identity to an amino acid sequence of SEQ ID NO:80. In some embodiments, the antibody comprises a heavy chain having an amino acid sequence having at least 95% identity to an amino acid sequence of SEQ ID NO:666. In some embodiments, the antibody comprises a light chain having an amino acid sequence having at least 95% identity to an amino acid sequence of SEQ ID NO:667. In some embodiments, the antibody comprises a heavy chain having an amino acid sequence having at least 95% identity to an amino acid sequence of SEQ ID NO:666, and a light chain having an amino acid sequence having at least 95% identity to an amino acid sequence of SEQ ID NO:667.

In another aspect, provided herein is an antibody that binds Vβ17, comprising: (i) a VH comprising a VH CDR1 having an amino acid sequence of SEQ ID NO:59, a VH CDR2 having an amino acid sequence of SEQ ID NO:49, and a VH CDR3 having an amino acid sequence of SEQ ID NO:60; and (ii) a VL comprising a VL CDR1 having an amino acid sequence of SEQ ID NO:61, a VL CDR2 having an amino acid sequence of SEQ ID NO:62, and a VL CDR3 having an amino acid sequence of SEQ ID NO:63. In another aspect, provided herein is an antibody that binds Vβ17, comprising: (i) a VH comprising a VH CDR1 having an amino acid sequence of SEQ ID NO:391, a VH CDR2 having an amino acid sequence of SEQ ID NO:392, and a VH CDR3 having an amino acid sequence of SEQ ID NO:393; and (ii) a VL comprising a VL CDR1 having an amino acid sequence of SEQ ID NO:394, a VL CDR2 having an amino acid sequence of SEQ ID NO:395, and a VL CDR3 having an amino acid sequence of SEQ ID NO:396. In another aspect, provided herein is an antibody that binds Vβ17, comprising: (i) a VH comprising a VH CDR1 having an amino acid sequence of SEQ ID NO:397, a VH CDR2 having an amino acid sequence of SEQ ID NO:398, and a VH CDR3 having an amino acid sequence of SEQ ID NO:399; and (ii) a VL comprising a VL CDR1 having an amino acid sequence of SEQ ID NO:400, a VL CDR2 having an amino acid sequence of SEQ ID NO:401, and a VL CDR3 having an amino acid sequence of SEQ ID NO:402. In another aspect, provided herein is an antibody that binds Vβ17, comprising: (i) a VH comprising a VH CDR1 having an amino acid sequence of SEQ ID NO:403, a VH CDR2 having an amino acid sequence of SEQ ID NO:404, and a VH CDR3 having an amino acid sequence of SEQ ID NO:405; and (ii) a VL comprising a VL CDR1 having an amino acid sequence of SEQ ID NO:406, a VL CDR2 having an amino acid sequence of SEQ ID NO:407, and a VL CDR3 having an amino acid sequence of SEQ ID NO:408. In another aspect, provided herein is an antibody that binds Vβ17, comprising: (i) a VH comprising a VH CDR1 having an amino acid sequence of SEQ ID NO:409, a VH CDR2 having an amino acid sequence of SEQ ID NO:410, and a VH CDR3 having an amino acid sequence of SEQ ID NO:411; and (ii) a VL comprising a VL CDR1 having an amino acid sequence of SEQ ID NO:412, a VL CDR2 having an amino acid sequence of SEQ ID NO:413, and a VL CDR3 having an amino acid sequence of SEQ ID NO:414. In another aspect, provided herein is an antibody that binds Vβ17, comprising: (i) a VH comprising a VH CDR1 having an amino acid sequence of SEQ ID NO:415, a VH CDR2 having an amino acid sequence of SEQ ID NO:416, and a VH CDR3 having an amino acid sequence of SEQ ID NO:417; and (ii) a VL comprising a VL CDR1 having an amino acid sequence of SEQ ID NO:418, a VL CDR2 having an amino acid sequence of SEQ ID NO:419, and a VL CDR3 having an amino acid sequence of SEQ ID NO:420. In another aspect, provided herein is an antibody that binds Vβ17, comprising: (i) a VH comprising a VH CDR1 having an amino acid sequence of SEQ ID NO:421, a VH CDR2 having an amino acid sequence of SEQ ID NO:422, and a VH CDR3 having an amino acid sequence of SEQ ID NO:423; and (ii) a VL comprising a VL CDR1 having an amino acid sequence of SEQ ID NO:424, a VL CDR2 having an amino acid sequence of SEQ ID NO:425, and a VL CDR3 having an amino acid sequence of SEQ ID NO:426. In another aspect, provided herein is an antibody that binds Vβ17, comprising: (i) a VH comprising a VH CDR1 having an amino acid sequence of SEQ ID NO:427, a VH CDR2 having an amino acid sequence of SEQ ID NO:428, and a VH CDR3 having an amino acid sequence of SEQ ID NO:429; and (ii) a VL comprising a VL CDR1 having an amino acid sequence of SEQ ID NO:430, a VL CDR2 having an amino acid sequence of SEQ ID NO:431, and a VL CDR3 having an amino acid sequence of SEQ ID NO:432. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:81. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:82. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:81; and (ii) a VL comprising a VL CDR1, a VL CDR2, and a VL CDR3 having an amino acid sequence of a VL CDR1, VL CDR2, and VL CDR3, respectively, of SEQ ID NO:82. In some embodiments, the antibody comprises a VH having an amino acid sequence of SEQ ID NO:81. In some embodiments, the antibody comprises a VL having an amino acid sequence of SEQ ID NO:82. In some embodiments, the antibody comprises a VH having an amino acid sequence of SEQ ID NO:81, and a VL having an amino acid sequence of SEQ ID NO:82. In some embodiments, the antibody comprises a heavy chain having an amino acid sequence of SEQ ID NO:668. In some embodiments, the antibody comprises a light chain having an amino acid sequence of SEQ ID NO:669. In some embodiments, the antibody comprises a heavy chain having an amino acid sequence of SEQ ID NO:668, and a light chain having an amino acid sequence of SEQ ID NO:669. In some embodiments, the antibody comprises a VH having an amino acid sequence having at least 95% identity to an amino acid sequence of SEQ ID NO:81. In some embodiments, the antibody comprises a VL having an amino acid sequence having at least 95% identity to an amino acid sequence of SEQ ID NO:82. In some embodiments, the antibody comprises a VH having an amino acid sequence having at least 95% identity to an amino acid sequence of SEQ ID NO:81, and a VL having an amino acid sequence having at least 95% identity to an amino acid sequence of SEQ ID NO:82. In some embodiments, the antibody comprises a heavy chain having an amino acid sequence having at least 95% identity to an amino acid sequence of SEQ ID NO:668. In some embodiments, the antibody comprises a light chain having an amino acid sequence having at least 95% identity to an amino acid sequence of SEQ ID NO:669. In some embodiments, the antibody comprises a heavy chain having an amino acid sequence having at least 95% identity to an amino acid sequence of SEQ ID NO:668, and a light chain having an amino acid sequence having at least 95% identity to an amino acid sequence of SEQ ID NO:669.

In another aspect, provided herein is an antibody that binds Vβ17, comprising: (i) a VH comprising a VH CDR1 having an amino acid sequence of SEQ ID NO:64, a VH CDR2 having an amino acid sequence of SEQ ID NO:65, and a VH CDR3 having an amino acid sequence of SEQ ID NO:66; and (ii) a VL comprising a VL CDR1 having an amino acid sequence of SEQ ID NO:67, a VL CDR2 having an amino acid sequence of SEQ ID NO:68, and a VL CDR3 having an amino acid sequence of SEQ ID NO:69. In another aspect, provided herein is an antibody that binds Vβ17, comprising: (i) a VH comprising a VH CDR1 having an amino acid sequence of SEQ ID NO:433, a VH CDR2 having an amino acid sequence of SEQ ID NO:434, and a VH CDR3 having an amino acid sequence of SEQ ID NO:435; and (ii) a VL comprising a VL CDR1 having an amino acid sequence of SEQ ID NO:436, a VL CDR2 having an amino acid sequence of SEQ ID NO:437, and a VL CDR3 having an amino acid sequence of SEQ ID NO:438. In another aspect, provided herein is an antibody that binds Vβ17, comprising: (i) a VH comprising a VH CDR1 having an amino acid sequence of SEQ ID NO:439, a VH CDR2 having an amino acid sequence of SEQ ID NO:440, and a VH CDR3 having an amino acid sequence of SEQ ID NO:441; and (ii) a VL comprising a VL CDR1 having an amino acid sequence of SEQ ID NO:442, a VL CDR2 having an amino acid sequence of SEQ ID NO:443, and a VL CDR3 having an amino acid sequence of SEQ ID NO:444. In another aspect, provided herein is an antibody that binds Vβ17, comprising: (i) a VH comprising a VH CDR1 having an amino acid sequence of SEQ ID NO:445, a VH CDR2 having an amino acid sequence of SEQ ID NO:446, and a VH CDR3 having an amino acid sequence of SEQ ID NO:447; and (ii) a VL comprising a VL CDR1 having an amino acid sequence of SEQ ID NO:448, a VL CDR2 having an amino acid sequence of SEQ ID NO:449, and a VL CDR3 having an amino acid sequence of SEQ ID NO:450. In another aspect, provided herein is an antibody that binds Vβ17, comprising: (i) a VH comprising a VH CDR1 having an amino acid sequence of SEQ ID NO:451, a VH CDR2 having an amino acid sequence of SEQ ID NO:452, and a VH CDR3 having an amino acid sequence of SEQ ID NO:453; and (ii) a VL comprising a VL CDR1 having an amino acid sequence of SEQ ID NO:454, a VL CDR2 having an amino acid sequence of SEQ ID NO:455, and a VL CDR3 having an amino acid sequence of SEQ ID NO:456. In another aspect, provided herein is an antibody that binds Vβ17, comprising: (i) a VH comprising a VH CDR1 having an amino acid sequence of SEQ ID NO:457, a VH CDR2 having an amino acid sequence of SEQ ID NO:458, and a VH CDR3 having an amino acid sequence of SEQ ID NO:459; and (ii) a VL comprising a VL CDR1 having an amino acid sequence of SEQ ID NO:460, a VL CDR2 having an amino acid sequence of SEQ ID NO:461, and a VL CDR3 having an amino acid sequence of SEQ ID NO:462. In another aspect, provided herein is an antibody that binds Vβ17, comprising: (i) a VH comprising a VH CDR1 having an amino acid sequence of SEQ ID NO:463, a VH CDR2 having an amino acid sequence of SEQ ID NO:464, and a VH CDR3 having an amino acid sequence of SEQ ID NO:465; and (ii) a VL comprising a VL CDR1 having an amino acid sequence of SEQ ID NO:466, a VL CDR2 having an amino acid sequence of SEQ ID NO:467, and a VL CDR3 having an amino acid sequence of SEQ ID NO:468. In another aspect, provided herein is an antibody that binds Vβ17, comprising: (i) a VH comprising a VH CDR1 having an amino acid sequence of SEQ ID NO:469, a VH CDR2 having an amino acid sequence of SEQ ID NO:470, and a VH CDR3 having an amino acid sequence of SEQ ID NO:471; and (ii) a VL comprising a VL CDR1 having an amino acid sequence of SEQ ID NO:472, a VL CDR2 having an amino acid sequence of SEQ ID NO:473, and a VL CDR3 having an amino acid sequence of SEQ ID NO:474. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:83. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:84. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:83; and (ii) a VL comprising a VL CDR1, a VL CDR2, and a VL CDR3 having an amino acid sequence of a VL CDR1, VL CDR2, and VL CDR3, respectively, of SEQ ID NO:84. In some embodiments, the antibody comprises a VH having an amino acid sequence of SEQ ID NO:83. In some embodiments, the antibody comprises a VL having an amino acid sequence of SEQ ID NO:84. In some embodiments, the antibody comprises a VH having an amino acid sequence of SEQ ID NO:83, and a VL having an amino acid sequence of SEQ ID NO:84. In some embodiments, the antibody comprises a heavy chain having an amino acid sequence of SEQ ID NO:670. In some embodiments, the antibody comprises a light chain having an amino acid sequence of SEQ ID NO:671. In some embodiments, the antibody comprises a heavy chain having an amino acid sequence of SEQ ID NO:670, and a light chain having an amino acid sequence of SEQ ID NO:671. In some embodiments, the antibody comprises a VH having an amino acid sequence having at least 95% identity to an amino acid sequence of SEQ ID NO:83. In some embodiments, the antibody comprises a VL having an amino acid sequence having at least 95% identity to an amino acid sequence of SEQ ID NO:84. In some embodiments, the antibody comprises a VH having an amino acid sequence having at least 95% identity to an amino acid sequence of SEQ ID NO:83, and a VL having an amino acid sequence having at least 95% identity to an amino acid sequence of SEQ ID NO:84. In some embodiments, the antibody comprises a heavy chain having an amino acid sequence having at least 95% identity to an amino acid sequence of SEQ ID NO:670. In some embodiments, the antibody comprises a light chain having an amino acid sequence having at least 95% identity to an amino acid sequence of SEQ ID NO:671. In some embodiments, the antibody comprises a heavy chain having an amino acid sequence having at least 95% identity to an amino acid sequence of SEQ ID NO:670, and a light chain having an amino acid sequence having at least 95% identity to an amino acid sequence of SEQ ID NO:671.

In another aspect, provided herein is an antibody that binds Vβ17, comprising: (i) a VH comprising a VH CDR1 having an amino acid sequence of SEQ ID NO:70, a VH CDR2 having an amino acid sequence of SEQ ID NO:49, and a VH CDR3 having an amino acid sequence of SEQ ID NO:71; and (ii) a VL comprising a VL CDR1 having an amino acid sequence of SEQ ID NO:61, a VL CDR2 having an amino acid sequence of SEQ ID NO:72, and a VL CDR3 having an amino acid sequence of SEQ ID NO:73. In another aspect, provided herein is an antibody that binds Vβ17, comprising: (i) a VH comprising a VH CDR1 having an amino acid sequence of SEQ ID NO:475, a VH CDR2 having an amino acid sequence of SEQ ID NO:476, and a VH CDR3 having an amino acid sequence of SEQ ID NO:477; and (ii) a VL comprising a VL CDR1 having an amino acid sequence of SEQ ID NO:478, a VL CDR2 having an amino acid sequence of SEQ ID NO:479, and a VL CDR3 having an amino acid sequence of SEQ ID NO:480. In another aspect, provided herein is an antibody that binds Vβ17, comprising: (i) a VH comprising a VH CDR1 having an amino acid sequence of SEQ ID NO:481, a VH CDR2 having an amino acid sequence of SEQ ID NO:482, and a VH CDR3 having an amino acid sequence of SEQ ID NO:483; and (ii) a VL comprising a VL CDR1 having an amino acid sequence of SEQ ID NO:484, a VL CDR2 having an amino acid sequence of SEQ ID NO:485, and a VL CDR3 having an amino acid sequence of SEQ ID NO:486. In another aspect, provided herein is an antibody that binds Vβ17, comprising: (i) a VH comprising a VH CDR1 having an amino acid sequence of SEQ ID NO:487, a VH CDR2 having an amino acid sequence of SEQ ID NO:488, and a VH CDR3 having an amino acid sequence of SEQ ID NO:489; and (ii) a VL comprising a VL CDR1 having an amino acid sequence of SEQ ID NO:490, a VL CDR2 having an amino acid sequence of SEQ ID NO:491, and a VL CDR3 having an amino acid sequence of SEQ ID NO:492. In another aspect, provided herein is an antibody that binds Vβ17, comprising: (i) a VH comprising a VH CDR1 having an amino acid sequence of SEQ ID NO:493, a VH CDR2 having an amino acid sequence of SEQ ID NO:494, and a VH CDR3 having an amino acid sequence of SEQ ID NO:495; and (ii) a VL comprising a VL CDR1 having an amino acid sequence of SEQ ID NO:496, a VL CDR2 having an amino acid sequence of SEQ ID NO:497, and a VL CDR3 having an amino acid sequence of SEQ ID NO:498. In another aspect, provided herein is an antibody that binds Vβ17, comprising: (i) a VH comprising a VH CDR1 having an amino acid sequence of SEQ ID NO:499, a VH CDR2 having an amino acid sequence of SEQ ID NO:500, and a VH CDR3 having an amino acid sequence of SEQ ID NO:501; and (ii) a VL comprising a VL CDR1 having an amino acid sequence of SEQ ID NO:502, a VL CDR2 having an amino acid sequence of SEQ ID NO:503, and a VL CDR3 having an amino acid sequence of SEQ ID NO:504. In another aspect, provided herein is an antibody that binds Vβ17, comprising: (i) a VH comprising a VH CDR1 having an amino acid sequence of SEQ ID NO:505, a VH CDR2 having an amino acid sequence of SEQ ID NO:506, and a VH CDR3 having an amino acid sequence of SEQ ID NO:507; and (ii) a VL comprising a VL CDR1 having an amino acid sequence of SEQ ID NO:508, a VL CDR2 having an amino acid sequence of SEQ ID NO:509, and a VL CDR3 having an amino acid sequence of SEQ ID NO:510. In another aspect, provided herein is an antibody that binds Vβ17, comprising: (i) a VH comprising a VH CDR1 having an amino acid sequence of SEQ ID NO:511, a VH CDR2 having an amino acid sequence of SEQ ID NO:512, and a VH CDR3 having an amino acid sequence of SEQ ID NO:513; and (ii) a VL comprising a VL CDR1 having an amino acid sequence of SEQ ID NO:514, a VL CDR2 having an amino acid sequence of SEQ ID NO:515, and a VL CDR3 having an amino acid sequence of SEQ ID NO:516. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:85. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:86. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:85; and (ii) a VL comprising a VL CDR1, a VL CDR2, and a VL CDR3 having an amino acid sequence of a VL CDR1, VL CDR2, and VL CDR3, respectively, of SEQ ID NO:86. In some embodiments, the antibody comprises a VH having an amino acid sequence of SEQ ID NO:85. In some embodiments, the antibody comprises a VL having an amino acid sequence of SEQ ID NO:86. In some embodiments, the antibody comprises a VH having an amino acid sequence of SEQ ID NO:85, and a VL having an amino acid sequence of SEQ ID NO:86. In some embodiments, the antibody comprises a heavy chain having an amino acid sequence of SEQ ID NO:672. In some embodiments, the antibody comprises a light chain having an amino acid sequence of SEQ ID NO:673. In some embodiments, the antibody comprises a heavy chain having an amino acid sequence of SEQ ID NO:672, and a light chain having an amino acid sequence of SEQ ID NO:673. In some embodiments, the antibody comprises a VH having an amino acid sequence having at least 95% identity to an amino acid sequence of SEQ ID NO:85. In some embodiments, the antibody comprises a VL having an amino acid sequence having at least 95% identity to an amino acid sequence of SEQ ID NO:86. In some embodiments, the antibody comprises a VH having an amino acid sequence having at least 95% identity to an amino acid sequence of SEQ ID NO:85, and a VL having an amino acid sequence having at least 95% identity to an amino acid sequence of SEQ ID NO:86. In some embodiments, the antibody comprises a heavy chain having an amino acid sequence having at least 95% identity to an amino acid sequence of SEQ ID NO:672. In some embodiments, the antibody comprises a light chain having an amino acid sequence having at least 95% identity to an amino acid sequence of SEQ ID NO:673. In some embodiments, the antibody comprises a heavy chain having an amino acid sequence having at least 95% identity to an amino acid sequence of SEQ ID NO:672, and a light chain having an amino acid sequence having at least 95% identity to an amino acid sequence of SEQ ID NO:673.

In another aspect, provided herein is an antibody that binds Vβ17, comprising: (i) a VH comprising a VH CDR1 having an amino acid sequence of SEQ ID NO:48, a VH CDR2 having an amino acid sequence of SEQ ID NO:74, and a VH CDR3 having an amino acid sequence of SEQ ID NO:75; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:76. In another aspect, provided herein is an antibody that binds Vβ17, comprising: (i) a VH comprising a VH CDR1 having an amino acid sequence of SEQ ID NO:517, a VH CDR2 having an amino acid sequence of SEQ ID NO:518, and a VH CDR3 having an amino acid sequence of SEQ ID NO:519; and (ii) a VL comprising a VL CDR1 having an amino acid sequence of SEQ ID NO:520, a VL CDR2 having an amino acid sequence of SEQ ID NO:521, and a VL CDR3 having an amino acid sequence of SEQ ID NO:522. In another aspect, provided herein is an antibody that binds Vβ17, comprising: (i) a VH comprising a VH CDR1 having an amino acid sequence of SEQ ID NO:523, a VH CDR2 having an amino acid sequence of SEQ ID NO:524, and a VH CDR3 having an amino acid sequence of SEQ ID NO:525; and (ii) a VL comprising a VL CDR1 having an amino acid sequence of SEQ ID NO:526, a VL CDR2 having an amino acid sequence of SEQ ID NO:527, and a VL CDR3 having an amino acid sequence of SEQ ID NO:528. In another aspect, provided herein is an antibody that binds Vβ17, comprising: (i) a VH comprising a VH CDR1 having an amino acid sequence of SEQ ID NO:529, a VH CDR2 having an amino acid sequence of SEQ ID NO:530, and a VH CDR3 having an amino acid sequence of SEQ ID NO:531; and (ii) a VL comprising a VL CDR1 having an amino acid sequence of SEQ ID NO:532, a VL CDR2 having an amino acid sequence of SEQ ID NO:533, and a VL CDR3 having an amino acid sequence of SEQ ID NO:534. In another aspect, provided herein is an antibody that binds Vβ17, comprising: (i) a VH comprising a VH CDR1 having an amino acid sequence of SEQ ID NO:535, a VH CDR2 having an amino acid sequence of SEQ ID NO:536, and a VH CDR3 having an amino acid sequence of SEQ ID NO:537; and (ii) a VL comprising a VL CDR1 having an amino acid sequence of SEQ ID NO:538, a VL CDR2 having an amino acid sequence of SEQ ID NO:539, and a VL CDR3 having an amino acid sequence of SEQ ID NO:540. In another aspect, provided herein is an antibody that binds Vβ17, comprising: (i) a VH comprising a VH CDR1 having an amino acid sequence of SEQ ID NO:541, a VH CDR2 having an amino acid sequence of SEQ ID NO:542, and a VH CDR3 having an amino acid sequence of SEQ ID NO:543; and (ii) a VL comprising a VL CDR1 having an amino acid sequence of SEQ ID NO:544, a VL CDR2 having an amino acid sequence of SEQ ID NO:545, and a VL CDR3 having an amino acid sequence of SEQ ID NO:546. In another aspect, provided herein is an antibody that binds Vβ17, comprising: (i) a VH comprising a VH CDR1 having an amino acid sequence of SEQ ID NO:547, a VH CDR2 having an amino acid sequence of SEQ ID NO:548, and a VH CDR3 having an amino acid sequence of SEQ ID NO:549; and (ii) a VL comprising a VL CDR1 having an amino acid sequence of SEQ ID NO:550, a VL CDR2 having an amino acid sequence of SEQ ID NO:551, and a VL CDR3 having an amino acid sequence of SEQ ID NO:552. In another aspect, provided herein is an antibody that binds Vβ17, comprising: (i) a VH comprising a VH CDR1 having an amino acid sequence of SEQ ID NO:553, a VH CDR2 having an amino acid sequence of SEQ ID NO:554, and a VH CDR3 having an amino acid sequence of SEQ ID NO:555; and (ii) a VL comprising a VL CDR1 having an amino acid sequence of SEQ ID NO:556, a VL CDR2 having an amino acid sequence of SEQ ID NO:557, and a VL CDR3 having an amino acid sequence of SEQ ID NO:558. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:87. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:88. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:87; and (ii) a VL comprising a VL CDR1, a VL CDR2, and a VL CDR3 having an amino acid sequence of a VL CDR1, VL CDR2, and VL CDR3, respectively, of SEQ ID NO:88. In some embodiments, the antibody comprises a VH having an amino acid sequence of SEQ ID NO:87. In some embodiments, the antibody comprises a VL having an amino acid sequence of SEQ ID NO:88. In some embodiments, the antibody comprises a VH having an amino acid sequence of SEQ ID NO:87, and a VL having an amino acid sequence of SEQ ID NO:88. In some embodiments, the antibody comprises a heavy chain having an amino acid sequence of SEQ ID NO:674. In some embodiments, the antibody comprises a light chain having an amino acid sequence of SEQ ID NO:675. In some embodiments, the antibody comprises a heavy chain having an amino acid sequence of SEQ ID NO:674, and a light chain having an amino acid sequence of SEQ ID NO:675. In some embodiments, the antibody comprises a VH having an amino acid sequence having at least 95% identity to an amino acid sequence of SEQ ID NO:87. In some embodiments, the antibody comprises a VL having an amino acid sequence having at least 95% identity to an amino acid sequence of SEQ ID NO:88. In some embodiments, the antibody comprises a VH having an amino acid sequence having at least 95% identity to an amino acid sequence of SEQ ID NO:87, and a VL having an amino acid sequence having at least 95% identity to an amino acid sequence of SEQ ID NO:88. In some embodiments, the antibody comprises a heavy chain having an amino acid sequence having at least 95% identity to an amino acid sequence of SEQ ID NO:674. In some embodiments, the antibody comprises a light chain having an amino acid sequence having at least 95% identity to an amino acid sequence of SEQ ID NO:675. In some embodiments, the antibody comprises a heavy chain having an amino acid sequence having at least 95% identity to an amino acid sequence of SEQ ID NO:674, and a light chain having an amino acid sequence having at least 95% identity to an amino acid sequence of SEQ ID NO:675.

In another aspect, provided herein is an antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:676, a VL CDR2 having an amino acid sequence of SEQ ID NO:5, and a VL CDR3 having an amino acid sequence of SEQ ID NO:6. In another aspect, provided herein is an antibody that binds Vβ17, comprising: (i) a VH comprising a VH CDR1 having an amino acid sequence of SEQ ID NO:223, a VH CDR2 having an amino acid sequence of SEQ ID NO:224, and a VH CDR3 having an amino acid sequence of SEQ ID NO:225; and (ii) a VL comprising a VL CDR1 having an amino acid sequence of SEQ ID NO:678, a VL CDR2 having an amino acid sequence of SEQ ID NO:227, and a VL CDR3 having an amino acid sequence of SEQ ID NO:228. In another aspect, provided herein is an antibody that binds Vβ17, comprising: (i) a VH comprising a VH CDR1 having an amino acid sequence of SEQ ID NO:229, a VH CDR2 having an amino acid sequence of SEQ ID NO:230, and a VH CDR3 having an amino acid sequence of SEQ ID NO:231; and (ii) a VL comprising a VL CDR1 having an amino acid sequence of SEQ ID NO:679, a VL CDR2 having an amino acid sequence of SEQ ID NO:233, and a VL CDR3 having an amino acid sequence of SEQ ID NO:234. In another aspect, provided herein is an antibody that binds Vβ17, comprising: (i) a VH comprising a VH CDR1 having an amino acid sequence of SEQ ID NO:235, a VH CDR2 having an amino acid sequence of SEQ ID NO:236, and a VH CDR3 having an amino acid sequence of SEQ ID NO:237; and (ii) a VL comprising a VL CDR1 having an amino acid sequence of SEQ ID NO:680, a VL CDR2 having an amino acid sequence of SEQ ID NO:239, and a VL CDR3 having an amino acid sequence of SEQ ID NO:240. In another aspect, provided herein is an antibody that binds Vβ17, comprising: (i) a VH comprising a VH CDR1 having an amino acid sequence of SEQ ID NO:241, a VH CDR2 having an amino acid sequence of SEQ ID NO:242, and a VH CDR3 having an amino acid sequence of SEQ ID NO:243; and (ii) a VL comprising a VL CDR1 having an amino acid sequence of SEQ ID NO:681, a VL CDR2 having an amino acid sequence of SEQ ID NO:245, and a VL CDR3 having an amino acid sequence of SEQ ID NO:246. In another aspect, provided herein is an antibody that binds Vβ17, comprising: (i) a VH comprising a VH CDR1 having an amino acid sequence of SEQ ID NO:241, a VH CDR2 having an amino acid sequence of SEQ ID NO:682, and a VH CDR3 having an amino acid sequence of SEQ ID NO:683; and (ii) a VL comprising a VL CDR1 having an amino acid sequence of SEQ ID NO:684, a VL CDR2 having an amino acid sequence of SEQ ID NO:245, and a VL CDR3 having an amino acid sequence of SEQ ID NO:246. In another aspect, provided herein is an antibody that binds Vβ17, comprising: (i) a VH comprising a VH CDR1 having an amino acid sequence of SEQ ID NO:241, a VH CDR2 having an amino acid sequence of SEQ ID NO:687, and a VH CDR3 having an amino acid sequence of SEQ ID NO:683; and (ii) a VL comprising a VL CDR1 having an amino acid sequence of SEQ ID NO:684, a VL CDR2 having an amino acid sequence of SEQ ID NO:245, and a VL CDR3 having an amino acid sequence of SEQ ID NO:246. In another aspect, provided herein is an antibody that binds Vβ17, comprising: (i) a VH comprising a VH CDR1 having an amino acid sequence of SEQ ID NO:253, a VH CDR2 having an amino acid sequence of SEQ ID NO:254, and a VH CDR3 having an amino acid sequence of SEQ ID NO:255; and (ii) a VL comprising a VL CDR1 having an amino acid sequence of SEQ ID NO:685, a VL CDR2 having an amino acid sequence of SEQ ID NO:257, and a VL CDR3 having an amino acid sequence of SEQ ID NO:258. In another aspect, provided herein is an antibody that binds Vβ17, comprising: (i) a VH comprising a VH CDR1 having an amino acid sequence of SEQ ID NO:259, a VH CDR2 having an amino acid sequence of SEQ ID NO:260, and a VH CDR3 having an amino acid sequence of SEQ ID NO:261; and (ii) a VL comprising a VL CDR1 having an amino acid sequence of SEQ ID NO:686, a VL CDR2 having an amino acid sequence of SEQ ID NO:263, and a VL CDR3 having an amino acid sequence of SEQ ID NO:264. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:21. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:677. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:677. In some embodiments, the antibody comprises a VH having an amino acid sequence of SEQ ID NO:21. In some embodiments, the antibody comprises a VL having an amino acid sequence of SEQ ID NO:677. In some embodiments, the antibody comprises a VH having an amino acid sequence of SEQ ID NO:21, and a VL having an amino acid sequence of SEQ ID NO:677. In some embodiments, the antibody comprises a VH having an amino acid sequence having at least 95% identity to an amino acid sequence of SEQ ID NO:21. In some embodiments, the antibody comprises a VL having an amino acid sequence having at least 95% identity to an amino acid sequence of SEQ ID NO:677. In some embodiments, the antibody comprises a VH having an amino acid sequence having at least 95% identity to an amino acid sequence of SEQ ID NO:21, and a VL having an amino acid sequence having at least 95% identity to an amino acid sequence of SEQ ID NO:677.

In another aspect, provided herein is an antibody that binds Vβ17, comprising: (i) a VH comprising a VH CDR1 having an amino acid sequence of SEQ ID NO:973, a VH CDR2 having an amino acid sequence of SEQ ID NO:974, and a VH CDR3 having an amino acid sequence of SEQ ID NO:975; and (ii) a VL comprising a VL CDR1 having an amino acid sequence of SEQ ID NO:988, a VL CDR2 having an amino acid sequence of SEQ ID NO:989, and a VL CDR3 having an amino acid sequence of SEQ ID NO:990. In another aspect, provided herein is an antibody that binds Vβ17, comprising: (i) a VH comprising a VH CDR1 having an amino acid sequence of SEQ ID NO:976, a VH CDR2 having an amino acid sequence of SEQ ID NO:977, and a VH CDR3 having an amino acid sequence of SEQ ID NO:978; and (ii) a VL comprising a VL CDR1 having an amino acid sequence of SEQ ID NO:991, a VL CDR2 having an amino acid sequence of SEQ ID NO:992, and a VL CDR3 having an amino acid sequence of SEQ ID NO:993. In another aspect, provided herein is an antibody that binds Vβ17, comprising: (i) a VH comprising a VH CDR1 having an amino acid sequence of SEQ ID NO:970, a VH CDR2 having an amino acid sequence of SEQ ID NO:971, and a VH CDR3 having an amino acid sequence of SEQ ID NO:972; and (ii) a VL comprising a VL CDR1 having an amino acid sequence of SEQ ID NO:985, a VL CDR2 having an amino acid sequence of SEQ ID NO:986, and a VL CDR3 having an amino acid sequence of SEQ ID NO:987. In another aspect, provided herein is an antibody that binds Vβ17, comprising: (i) a VH comprising a VH CDR1 having an amino acid sequence of SEQ ID NO:982, a VH CDR2 having an amino acid sequence of SEQ ID NO:983, and a VH CDR3 having an amino acid sequence of SEQ ID NO:984; and (ii) a VL comprising a VL CDR1 having an amino acid sequence of SEQ ID NO:997, a VL CDR2 having an amino acid sequence of SEQ ID NO:998, and a VL CDR3 having an amino acid sequence of SEQ ID NO:999. In another aspect, provided herein is an antibody that binds Vβ17, comprising: (i) a VH comprising a VH CDR1 having an amino acid sequence of SEQ ID NO:979, a VH CDR2 having an amino acid sequence of SEQ ID NO:980, and a VH CDR3 having an amino acid sequence of SEQ ID NO:981; and (ii) a VL comprising a VL CDR1 having an amino acid sequence of SEQ ID NO:994, a VL CDR2 having an amino acid sequence of SEQ ID NO:995, and a VL CDR3 having an amino acid sequence of SEQ ID NO:996. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:1000. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:1001. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:1000; and (ii) a VL comprising a VL CDR1, a VL CDR2, and a VL CDR3 having an amino acid sequence of a VL CDR1, VL CDR2, and VL CDR3, respectively, of SEQ ID NO:1001. In some embodiments, the antibody comprises a VH having an amino acid sequence of SEQ ID NO:1000. In some embodiments, the antibody comprises a VL having an amino acid sequence of SEQ ID NO:1001. In some embodiments, the antibody comprises a VH having an amino acid sequence of SEQ ID NO:1000, and a VL having an amino acid sequence of SEQ ID NO:1001. In some embodiments, the antibody comprises a VH having an amino acid sequence having at least 95% identity to an amino acid sequence of SEQ ID NO:1000. In some embodiments, the antibody comprises a VL having an amino acid sequence having at least 95% identity to an amino acid sequence of SEQ ID NO:1001. In some embodiments, the antibody comprises a VH having an amino acid sequence having at least 95% identity to an amino acid sequence of SEQ ID NO:1000, and a VL having an amino acid sequence having at least 95% identity to an amino acid sequence of SEQ ID NO:1001.

In another aspect, provided herein is an antibody that binds Vβ17, comprising: (i) a VH comprising a VH CDR1 having an amino acid sequence of SEQ ID NO:1005, a VH CDR2 having an amino acid sequence of SEQ ID NO:1006, and a VH CDR3 having an amino acid sequence of SEQ ID NO:1007; and (ii) a VL comprising a VL CDR1 having an amino acid sequence of SEQ ID NO:1020, a VL CDR2 having an amino acid sequence of SEQ ID NO:1021, and a VL CDR3 having an amino acid sequence of SEQ ID NO:1022. In another aspect, provided herein is an antibody that binds Vβ17, comprising: (i) a VH comprising a VH CDR1 having an amino acid sequence of SEQ ID NO:1008, a VH CDR2 having an amino acid sequence of SEQ ID NO:1009, and a VH CDR3 having an amino acid sequence of SEQ ID NO:1010; and (ii) a VL comprising a VL CDR1 having an amino acid sequence of SEQ ID NO:1023, a VL CDR2 having an amino acid sequence of SEQ ID NO:1024, and a VL CDR3 having an amino acid sequence of SEQ ID NO:1025. In another aspect, provided herein is an antibody that binds Vβ17, comprising: (i) a VH comprising a VH CDR1 having an amino acid sequence of SEQ ID NO:1002, a VH CDR2 having an amino acid sequence of SEQ ID NO:1003, and a VH CDR3 having an amino acid sequence of SEQ ID NO:1004; and (ii) a VL comprising a VL CDR1 having an amino acid sequence of SEQ ID NO:1017, a VL CDR2 having an amino acid sequence of SEQ ID NO:1018, and a VL CDR3 having an amino acid sequence of SEQ ID NO:1019. In another aspect, provided herein is an antibody that binds Vβ17, comprising: (i) a VH comprising a VH CDR1 having an amino acid sequence of SEQ ID NO:1014, a VH CDR2 having an amino acid sequence of SEQ ID NO:1015, and a VH CDR3 having an amino acid sequence of SEQ ID NO:1016; and (ii) a VL comprising a VL CDR1 having an amino acid sequence of SEQ ID NO:1029, a VL CDR2 having an amino acid sequence of SEQ ID NO:1030, and a VL CDR3 having an amino acid sequence of SEQ ID NO:1031. In another aspect, provided herein is an antibody that binds Vβ17, comprising: (i) a VH comprising a VH CDR1 having an amino acid sequence of SEQ ID NO:1011, a VH CDR2 having an amino acid sequence of SEQ ID NO:1012, and a VH CDR3 having an amino acid sequence of SEQ ID NO:1013; and (ii) a VL comprising a VL CDR1 having an amino acid sequence of SEQ ID NO:1026, a VL CDR2 having an amino acid sequence of SEQ ID NO:1027, and a VL CDR3 having an amino acid sequence of SEQ ID NO:1028. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:1032. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:1033. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:1032; and (ii) a VL comprising a VL CDR1, a VL CDR2, and a VL CDR3 having an amino acid sequence of a VL CDR1, VL CDR2, and VL CDR3, respectively, of SEQ ID NO:1033. In some embodiments, the antibody comprises a VH having an amino acid sequence of SEQ ID NO:1032. In some embodiments, the antibody comprises a VL having an amino acid sequence of SEQ ID NO:1033. In some embodiments, the antibody comprises a VH having an amino acid sequence of SEQ ID NO:1032, and a VL having an amino acid sequence of SEQ ID NO:1033. In some embodiments, the antibody comprises a VH having an amino acid sequence having at least 95% identity to an amino acid sequence of SEQ ID NO:1032. In some embodiments, the antibody comprises a VL having an amino acid sequence having at least 95% identity to an amino acid sequence of SEQ ID NO:1033. In some embodiments, the antibody comprises a VH having an amino acid sequence having at least 95% identity to an amino acid sequence of SEQ ID NO:1032, and a VL having an amino acid sequence having at least 95% identity to an amino acid sequence of SEQ ID NO:1033.

In another aspect, provided herein is an antibody that binds Vβ17, comprising: (i) a VH comprising a VH CDR1 having an amino acid sequence of SEQ ID NO:1037, a VH CDR2 having an amino acid sequence of SEQ ID NO:1038, and a VH CDR3 having an amino acid sequence of SEQ ID NO:1039; and (ii) a VL comprising a VL CDR1 having an amino acid sequence of SEQ ID NO:1052, a VL CDR2 having an amino acid sequence of SEQ ID NO:1053, and a VL CDR3 having an amino acid sequence of SEQ ID NO:1054. In another aspect, provided herein is an antibody that binds Vβ17, comprising: (i) a VH comprising a VH CDR1 having an amino acid sequence of SEQ ID NO:1040, a VH CDR2 having an amino acid sequence of SEQ ID NO:1041, and a VH CDR3 having an amino acid sequence of SEQ ID NO:1042; and (ii) a VL comprising a VL CDR1 having an amino acid sequence of SEQ ID NO:1055, a VL CDR2 having an amino acid sequence of SEQ ID NO:1056, and a VL CDR3 having an amino acid sequence of SEQ ID NO:1057. In another aspect, provided herein is an antibody that binds Vβ17, comprising: (i) a VH comprising a VH CDR1 having an amino acid sequence of SEQ ID NO:1034, a VH CDR2 having an amino acid sequence of SEQ ID NO:1035, and a VH CDR3 having an amino acid sequence of SEQ ID NO:1036; and (ii) a VL comprising a VL CDR1 having an amino acid sequence of SEQ ID NO:1049, a VL CDR2 having an amino acid sequence of SEQ ID NO:1050, and a VL CDR3 having an amino acid sequence of SEQ ID NO:1051. In another aspect, provided herein is an antibody that binds Vβ17, comprising: (i) a VH comprising a VH CDR1 having an amino acid sequence of SEQ ID NO:1046, a VH CDR2 having an amino acid sequence of SEQ ID NO:1047, and a VH CDR3 having an amino acid sequence of SEQ ID NO:1048; and (ii) a VL comprising a VL CDR1 having an amino acid sequence of SEQ ID NO:1061, a VL CDR2 having an amino acid sequence of SEQ ID NO:1062, and a VL CDR3 having an amino acid sequence of SEQ ID NO:1063. In another aspect, provided herein is an antibody that binds Vβ17, comprising: (i) a VH comprising a VH CDR1 having an amino acid sequence of SEQ ID NO:1043, a VH CDR2 having an amino acid sequence of SEQ ID NO:1044, and a VH CDR3 having an amino acid sequence of SEQ ID NO:1045; and (ii) a VL comprising a VL CDR1 having an amino acid sequence of SEQ ID NO:1058, a VL CDR2 having an amino acid sequence of SEQ ID NO:1059, and a VL CDR3 having an amino acid sequence of SEQ ID NO:1060. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:1064. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:1065. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:1064; and (ii) a VL comprising a VL CDR1, a VL CDR2, and a VL CDR3 having an amino acid sequence of a VL CDR1, VL CDR2, and VL CDR3, respectively, of SEQ ID NO:1065. In some embodiments, the antibody comprises a VH having an amino acid sequence of SEQ ID NO:1064. In some embodiments, the antibody comprises a VL having an amino acid sequence of SEQ ID NO:1065. In some embodiments, the antibody comprises a VH having an amino acid sequence of SEQ ID NO:1064, and a VL having an amino acid sequence of SEQ ID NO:1065. In some embodiments, the antibody comprises a VH having an amino acid sequence having at least 95% identity to an amino acid sequence of SEQ ID NO:1064. In some embodiments, the antibody comprises a VL having an amino acid sequence having at least 95% identity to an amino acid sequence of SEQ ID NO:1065. In some embodiments, the antibody comprises a VH having an amino acid sequence having at least 95% identity to an amino acid sequence of SEQ ID NO:1064, and a VL having an amino acid sequence having at least 95% identity to an amino acid sequence of SEQ ID NO:1065.

In another aspect, provided herein is an antibody that binds Vβ17, comprising: (i) a VH comprising a VH CDR1 having an amino acid sequence of SEQ ID NO:1069, a VH CDR2 having an amino acid sequence of SEQ ID NO:1070, and a VH CDR3 having an amino acid sequence of SEQ ID NO:1071; and (ii) a VL comprising a VL CDR1 having an amino acid sequence of SEQ ID NO:1084, a VL CDR2 having an amino acid sequence of SEQ ID NO:1085, and a VL CDR3 having an amino acid sequence of SEQ ID NO:1086. In another aspect, provided herein is an antibody that binds Vβ17, comprising: (i) a VH comprising a VH CDR1 having an amino acid sequence of SEQ ID NO:1072, a VH CDR2 having an amino acid sequence of SEQ ID NO:1073, and a VH CDR3 having an amino acid sequence of SEQ ID NO:1074; and (ii) a VL comprising a VL CDR1 having an amino acid sequence of SEQ ID NO:1087, a VL CDR2 having an amino acid sequence of SEQ ID NO:1088, and a VL CDR3 having an amino acid sequence of SEQ ID NO:1089. In another aspect, provided herein is an antibody that binds Vβ17, comprising: (i) a VH comprising a VH CDR1 having an amino acid sequence of SEQ ID NO:1066, a VH CDR2 having an amino acid sequence of SEQ ID NO:1067, and a VH CDR3 having an amino acid sequence of SEQ ID NO:1068; and (ii) a VL comprising a VL CDR1 having an amino acid sequence of SEQ ID NO:1081, a VL CDR2 having an amino acid sequence of SEQ ID NO:1082, and a VL CDR3 having an amino acid sequence of SEQ ID NO:1083. In another aspect, provided herein is an antibody that binds Vβ17, comprising: (i) a VH comprising a VH CDR1 having an amino acid sequence of SEQ ID NO:1078, a VH CDR2 having an amino acid sequence of SEQ ID NO:1079, and a VH CDR3 having an amino acid sequence of SEQ ID NO:1080; and (ii) a VL comprising a VL CDR1 having an amino acid sequence of SEQ ID NO:1093, a VL CDR2 having an amino acid sequence of SEQ ID NO:1094, and a VL CDR3 having an amino acid sequence of SEQ ID NO:1095. In another aspect, provided herein is an antibody that binds Vβ17, comprising: (i) a VH comprising a VH CDR1 having an amino acid sequence of SEQ ID NO:1075, a VH CDR2 having an amino acid sequence of SEQ ID NO:1076, and a VH CDR3 having an amino acid sequence of SEQ ID NO:1077; and (ii) a VL comprising a VL CDR1 having an amino acid sequence of SEQ ID NO:1090, a VL CDR2 having an amino acid sequence of SEQ ID NO:1091, and a VL CDR3 having an amino acid sequence of SEQ ID NO:1092. In another aspect, provided herein is an antibody that binds Vβ17, comprising a VH comprising a VH CDR1, a VH CDR2, and a VH CDR3 having an amino sequence of a VH CDR1, VH CDR2, and VH CDR3, respectively, of SEQ ID NO:1096. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:1097. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:1096; and (ii) a VL comprising a VL CDR1, a VL CDR2, and a VL CDR3 having an amino acid sequence of a VL CDR1, VL CDR2, and VL CDR3, respectively, of SEQ ID NO:1097. In some embodiments, the antibody comprises a VH having an amino acid sequence of SEQ ID NO:1096. In some embodiments, the antibody comprises a VL having an amino acid sequence of SEQ ID NO:1097. In some embodiments, the antibody comprises a VH having an amino acid sequence of SEQ ID NO:1096, and a VL having an amino acid sequence of SEQ ID NO:1097. In some embodiments, the antibody comprises a VH having an amino acid sequence having at least 95% identity to an amino acid sequence of SEQ ID NO:1096. In some embodiments, the antibody comprises a VL having an amino acid sequence having at least 95% identity to an amino acid sequence of SEQ ID NO:1097. In some embodiments, the antibody comprises a VH having an amino acid sequence having at least 95% identity to an amino acid sequence of SEQ ID NO:1096, and a VL having an amino acid sequence having at least 95% identity to an amino acid sequence of SEQ ID NO:1097.

In another aspect, provided herein is an antibody that binds Vβ17, comprising: (i) a VH comprising a VH CDR1 having an amino acid sequence of SEQ ID NO:1101, a VH CDR2 having an amino acid sequence of SEQ ID NO:1102, and a VH CDR3 having an amino acid sequence of SEQ ID NO:1103; and (ii) a VL comprising a VL CDR1 having an amino acid sequence of SEQ ID NO:1116, a VL CDR2 having an amino acid sequence of SEQ ID NO:1117, and a VL CDR3 having an amino acid sequence of SEQ ID NO:1118. In another aspect, provided herein is an antibody that binds Vβ17, comprising: (i) a VH comprising a VH CDR1 having an amino acid sequence of SEQ ID NO:1104, a VH CDR2 having an amino acid sequence of SEQ ID NO:1105, and a VH CDR3 having an amino acid sequence of SEQ ID NO:1106; and (ii) a VL comprising a VL CDR1 having an amino acid sequence of SEQ ID NO:1119, a VL CDR2 having an amino acid sequence of SEQ ID NO:1120, and a VL CDR3 having an amino acid sequence of SEQ ID NO:1121. In another aspect, provided herein is an antibody that binds Vβ17, comprising: (i) a VH comprising a VH CDR1 having an amino acid sequence of SEQ ID NO:1098, a VH CDR2 having an amino acid sequence of SEQ ID NO:1099, and a VH CDR3 having an amino acid sequence of SEQ ID NO:1100; and (ii) a VL comprising a VL CDR1 having an amino acid sequence of SEQ ID NO:1113, a VL CDR2 having an amino acid sequence of SEQ ID NO:1114, and a VL CDR3 having an amino acid sequence of SEQ ID NO:1115. In another aspect, provided herein is an antibody that binds Vβ17, comprising: (i) a VH comprising a VH CDR1 having an amino acid sequence of SEQ ID NO:1110, a VH CDR2 having an amino acid sequence of SEQ ID NO:1111, and a VH CDR3 having an amino acid sequence of SEQ ID NO:1112; and (ii) a VL comprising a VL CDR1 having an amino acid sequence of SEQ ID NO:1125, a VL CDR2 having an amino acid sequence of SEQ ID NO:1126, and a VL CDR3 having an amino acid sequence of SEQ ID NO:1127. In another aspect, provided herein is an antibody that binds Vβ17, comprising: (i) a VH comprising a VH CDR1 having an amino acid sequence of SEQ ID NO:1107, a VH CDR2 having an amino acid sequence of SEQ ID NO:1108, and a VH CDR3 having an amino acid sequence of SEQ ID NO:1109; and (ii) a VL comprising a VL CDR1 having an amino acid sequence of SEQ ID NO:1122, a VL CDR2 having an amino acid sequence of SEQ ID NO:1123, and a VL CDR3 having an amino acid sequence of SEQ ID NO:1124. In another aspect, provided herein is an antibody that binds Vβ17, comprising a VH comprising a VH CDR1, a VH CDR2, and a VH CDR3 having an amino acid sequence of a VH CDR1, VH CDR2, and VH CDR3, respectively, of SEQ ID NO:1128. In another aspect, provided herein is an antibody that binds Vβ17, comprising a VL comprising a VL CDR1, a VL CDR2, and a VL CDR3 having an amino acid sequence of a VL CDR1, VL CDR2, and VL CDR3, respectively, of SEQ ID NO:1129. In another aspect, provided herein is an antibody that binds Vβ17, comprising: (i) a VH comprising a VH CDR1, a VH CDR2, and a VH CDR3 having an amino acid sequence of a VH CDR1, VH CDR2, and VH CDR3, respectively, of SEQ ID NO:1128; and (ii) a VL comprising a VL CDR1, a VL CDR2, and a VL CDR3 having an amino acid sequence of a VL CDR1, VL CDR2, and VL CDR3, respectively, of SEQ ID NO:1129. In some embodiments, the antibody comprises a VH having an amino acid sequence of SEQ ID NO:1128. In some embodiments, the antibody comprises a VL having an amino acid sequence of SEQ ID NO:1129. In some embodiments, the antibody comprises a VH having an amino acid sequence of SEQ ID NO:1128, and a VL having an amino acid sequence of SEQ ID NO:1129. In some embodiments, the antibody comprises a VH having an amino acid sequence having at least 95% identity to an amino acid sequence of SEQ ID NO:1128. In some embodiments, the antibody comprises a VL having an amino acid sequence having at least 95% identity to an amino acid sequence of SEQ ID NO:1129. In some embodiments, the antibody comprises a VH having an amino acid sequence having at least 95% identity to an amino acid sequence of SEQ ID NO:1128, and a VL having an amino acid sequence having at least 95% identity to an amino acid sequence of SEQ ID NO:1129.

In another aspect, provided herein is an antibody that competes for binding to Vβ17 with any of the Vβ17 antibodies described herein. In another aspect, provided herein is an antibody that binds to the same epitope as any of the Vβ17 antibodies described herein. In another aspect, provided is a Vβ17 antibody that binds an epitope on Vβ17 that overlaps with the epitope on Vβ17 bound by a Vβ17 antibody described herein.

In one aspect, provided is an antibody that competes for binding to Vβ17 with a Vβ17 reference antibody. In another aspect, provided is a Vβ17 antibody that binds to the same Vβ17 epitope as a Vβ17 reference antibody. In another aspect, provided is a Vβ17 antibody that binds an epitope on Vβ17 that overlaps with the epitope on Vβ17 bound by a Vβ17 reference antibody.

In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:25; and (ii) a VL comprising a VL CDR1, a VL CDR2, and a VL CDR3 having an amino acid sequence of a VL CDR1, VL CDR2, and VL CDR3, respectively, of SEQ ID NO:26. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:7; and (ii) a VL comprising a VL CDR1, a VL CDR2, and a VL CDR3 having an amino acid sequence of a VL CDR1, VL CDR2, and VL CDR3, respectively, of SEQ ID NO:8. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:9; and (ii) a VL comprising a VL CDR1, a VL CDR2, and a VL CDR3 having an amino acid sequence of a VL CDR1, VL CDR2, and VL CDR3, respectively, of SEQ ID NO:10. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:22. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:22. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:23. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:24. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:20; and (ii) a VL comprising a VL CDR1, a VL CDR2, and a VL CDR3 having an amino acid sequence of a VL CDR1, VL CDR2, and VL CDR3, respectively, of SEQ ID NO:22. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:20; and (ii) a VL comprising a VL CDR1, a VL CDR2, and a VL CDR3 having an amino acid sequence of a VL CDR1, VL CDR2, and VL CDR3, respectively, of SEQ ID NO:23. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:20; and (ii) a VL comprising a VL CDR1, a VL CDR2, and a VL CDR3 having an amino acid sequence of a VL CDR1, VL CDR2, and VL CDR3, respectively, of SEQ ID NO:24. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:22. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:23. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:24. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:46; and (ii) a VL comprising a VL CDR1, a VL CDR2, and a VL CDR3 having an amino acid sequence of a VL CDR1, VL CDR2, and VL CDR3, respectively, of SEQ ID NO:49. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:77; and (ii) a VL comprising a VL CDR1, a VL CDR2, and a VL CDR3 having an amino acid sequence of a VL CDR1, VL CDR2, and VL CDR3, respectively, of SEQ ID NO:78. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:79; and (ii) a VL comprising a VL CDR1, a VL CDR2, and a VL CDR3 having an amino acid sequence of a VL CDR1, VL CDR2, and VL CDR3, respectively, of SEQ ID NO:80. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:81; and (ii) a VL comprising a VL CDR1, a VL CDR2, and a VL CDR3 having an amino acid sequence of a VL CDR1, VL CDR2, and VL CDR3, respectively, of SEQ ID NO:82. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:83; and (ii) a VL comprising a VL CDR1, a VL CDR2, and a VL CDR3 having an amino acid sequence of a VL CDR1, VL CDR2, and VL CDR3, respectively, of SEQ ID NO:84. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:85; and (ii) a VL comprising a VL CDR1, a VL CDR2, and a VL CDR3 having an amino acid sequence of a VL CDR1, VL CDR2, and VL CDR3, respectively, of SEQ ID NO:86. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:87; and (ii) a VL comprising a VL CDR1, a VL CDR2, and a VL CDR3 having an amino acid sequence of a VL CDR1, VL CDR2, and VL CDR3, respectively, of SEQ ID NO:88. In one embodiment, the Vβ17 reference antibody comprises: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:677.

In some embodiments, the anti-Vβ17 antibody is a multispecific antibody. In other embodiments, the anti-Vβ17 antibody is a bispecific antibody. In certain embodiments, the multispecific antibody comprises an antigen binding fragment of an anti-Vβ17 antibody provided herein. In some embodiments, the multispecific antibody comprises a first binding domain that binds to a first Vβ17 epitope and a second domain that binds to a second Vβ17 epitope, wherein the first Vβ17 epitope and the second Vβ17 epitope are different. In certain embodiments, the multispecific antibody further comprises a third binding domain that binds to a target that is not Vβ17. In another aspect, provided herein is a multispecific antibody that binds Vβ17. In some embodiments, the multispecific antibody is a bispecific antibody. In some embodiments, the multispecific antibody is a trispecific antibody. In some embodiments, the multispecific antibody is a quadraspecific antibody. In one embodiment, the multispecific Vβ17 antibody comprises: (a) a first binding domain that binds Vβ17, and (b) a second binding domain that binds to a second target. In one embodiment, the multispecific Vβ17 antibody comprises: (a) a first binding domain that binds VB17, and (b) a second binding domain that binds to a second target, and (c) a third binding domain that binds to a third target. In one embodiment, the multispecific Vβ17 antibody comprises: (a) a first binding domain that binds Vβ17, and (b) a second binding domain that binds to a second target, (c) a third binding domain that binds to a third target, and (d) a fourth binding domain that binds to a fourth target.

In another aspect, provided herein is a multispecific antibody that binds Vβ17. In some embodiments, the multispecific antibody is a bispecific antibody. In some embodiments, the multispecific antibody is a trispecific antibody. In some embodiments, the multispecific antibody is a quadraspecific antibody. In one embodiment, the multispecific Vβ17 antibody comprises: (a) a first binding domain that binds Vβ17, and (b) a second binding domain that binds to a second target. In one embodiment, the multispecific Vβ17 antibody comprises: (a) a first binding domain that binds Vβ17, and (b) a second binding domain that binds to a second target, and (c) a third binding domain that binds to a third target. In one embodiment, the multispecific Vβ17 antibody comprises: (a) a first binding domain that binds Vβ17, and (b) a second binding domain that binds to a second target, (c) a third binding domain that binds to a third target, and (d) a fourth binding domain that binds to a fourth target.

In another aspect, provided herein is a multispecific antibody comprising: (a) a first binding domain that binds to Vβ17, and (b) a second binding domain that binds to a second target that is not Vβ17. In another aspect, provided herein is a multispecific antibody comprising: (a) a first binding domain that binds to Vβ17, and (b) a second binding domain that binds to a second target that is not Vβ17. In another aspect, provided herein is a multispecific antibody comprising: (a) a first binding domain that binds to Vβ17, and (b) a second binding domain that binds to a second target, wherein the second target is a cancer antigen. In another aspect, provided herein is a multispecific antibody comprising: (a) a first binding domain that binds to Vβ17, and (b) a second binding domain that binds to a second target, wherein the second target is a B cell antigen. In another aspect, provided herein is a multispecific antibody comprising: (a) a first binding domain that binds to Vβ17, and (b) a second binding domain that binds to a second target, wherein the second target is BCMA. In another aspect, provided herein is a multispecific antibody comprising: (a) a first binding domain that binds to Vβ17, and (b) a second binding domain that binds to a second target, wherein the second target is DLL3. In another aspect, provided herein is a multispecific antibody comprising: (a) a first binding domain that binds to Vβ17, and (b) a second binding domain that binds to a second target, wherein the second target is PSMA. In another aspect, provided herein is a multispecific antibody comprising: (a) a first binding domain that binds to Vβ17, and (b) a second binding domain that binds to a second target, wherein the second target is KLK2. In another aspect, provided herein is a bispecific antibody comprising: (a) a first binding domain that binds to Vβ17, and (b) a second binding domain that binds to a second target that is not Vβ17. In another aspect, provided herein is a bispecific antibody comprising: (a) a first binding domain that binds to Vβ17, and (b) a second binding domain that binds to a second target that is not Vβ17. In another aspect, provided herein is a bispecific antibody comprising: (a) a first binding domain that binds to Vβ17, and (b) a second binding domain that binds to a second target, wherein the second target is a cancer antigen. In another aspect, provided herein is a bispecific antibody comprising: (a) a first binding domain that binds to Vβ17, and (b) a second binding domain that binds to a second target, wherein the second target is a B cell antigen. In another aspect, provided herein is a bispecific antibody comprising: (a) a first binding domain that binds to Vβ17, and (b) a second binding domain that binds to a second target, wherein the second target is BCMA. In another aspect, provided herein is a bispecific antibody comprising: (a) a first binding domain that binds to Vβ17, and (b) a second binding domain that binds to a second target, wherein the second target is DLL3. In another aspect, provided herein is a bispecific antibody comprising: (a) a first binding domain that binds to Vβ17, and (b) a second binding domain that binds to a second target, wherein the second target is PSMA. In another aspect, provided herein is a bispecific antibody comprising: (a) a first binding domain that binds to Vβ17, and (b) a second binding domain that binds to a second target, wherein the second target is KLK2.

In certain embodiments, the first binding domain that binds to Vβ17 comprises a VH comprising a VH CDR1, a VH CDR2, and a VH CDR3 having an amino acid sequence of a VH CDR1, VH CDR2, and VH CDR3, respectively, of a Vβ17 antibody provided herein. In certain embodiments, the first binding domain that binds to Vβ17 comprises a VL comprising a VL CDR1, a VL CDR2, and a VL CDR3 having an amino acid sequence of a VL CDR1, VL CDR2, and VL CDR3, respectively, of a Vβ17 antibody provided herein. In certain embodiments, the first binding domain that binds to Vβ17 comprises a VH comprising a VH CDR1, a VH CDR2, and a VH CDR3 having an amino acid sequence of a VH CDR1, VH CDR2, and VH CDR3, and a VL comprising a VL CDR1, a VL CDR2, and a VL CDR3 having an amino acid sequence of a VL CDR1, VL CDR2, and VL CDR3, respectively, of a Vβ17 antibody provided herein. In certain embodiments, the first binding domain that binds to Vβ17 comprises a VH having an amino acid sequence of a VH of a Vβ17 antibody provided herein. In certain embodiments, the first binding domain that binds to Vβ17 comprises a VH having an amino acid sequence of a VH of a Vβ17 antibody provided herein. In certain embodiments, the first binding domain that binds to Vβ17 comprises a VL having an amino acid sequence of a VL of a Vβ17 antibody provided herein. In certain embodiments, the first binding domain that binds to Vβ17 comprises a VH having an amino acid sequence of a VH of a Vβ17 antibody provided herein, and a VL having an amino acid sequence of a VL of a Vβ17 antibody provided herein. In some embodiments, the Vβ17 antibody is clone E17.5F. In some embodiments, the Vβ17 antibody is clone B17B1. In some embodiments, the Vβ17 antibody is clone B17H1. In some embodiments, the Vβ17 antibody is clone B17H3. In some embodiments, the Vβ17 antibody is clone B17H4. In some embodiments, the Vβ17 antibody is clone B17H5. In some embodiments, the Vβ17 antibody is clone. In some embodiments, the Vβ17 antibody is clone B17B14. In some embodiments, the Vβ17 antibody is clone B17B15. In some embodiments, the Vβ17 antibody is clone B17B16. In some embodiments, the Vβ17 antibody is clone B17B17. In some embodiments, the Vβ17 antibody is clone B17B18. In some embodiments, the Vβ17 antibody is clone B17B19. In some embodiments, the Vβ17 antibody is clone B17B20. In some embodiments, the Vβ17 antibody is clone B17B21. In some embodiments, the Vβ17 antibody is clone B17B22. In some embodiments, the Vβ17 antibody is clone B17B2. In some embodiments, the Vβ17 antibody is clone Vb17_202B4D1. In some embodiments, the Vβ17 antibody is clone Vb17_210E10A1. In some embodiments, the Vβ17 antibody is clone B17B663. In some embodiments, the Vβ17 antibody is clone B17B694. In some embodiments, the Vβ17 antibody is clone B17B698. In some embodiments, the Vβ17 antibody is clone B17B733. In some embodiments, the Vβ17 antibody is clone Vb17_N33S. In some embodiments, the Vβ17 antibody is clone B17B860_G34Q. In some embodiments, the Vβ17 antibody is clone B17B852_G34R. In some embodiments, the Vβ17 antibody is clone B17B860_G34K. In some embodiments, the Vβ17 antibody is clone B17B852_N33T. In some embodiments, the Vβ17 antibody is clone B17B852_G34K. Other Vβ17 antibodies, including antigen binding fragments thereof, are also contemplated as the first binding arm that binds to Vβ17 of in the trispecific antibodies provided herein.

In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:25. In one embodiment, the first binding domain that binds to Vβ17 comprises a VL comprising a VL CDR1, a VL CDR2, and a VL CDR3 having an amino acid sequence of a VL CDR1, VL CDR2, and VL CDR3, respectively, of SEQ ID NO:26. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:25; and (ii) a VL comprising a VL CDR1, a VL CDR2, and a VL CDR3 having an amino acid sequence of a VL CDR1, VL CDR2, and VL CDR3, respectively, of SEQ ID NO:26. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:7. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:8. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:7; and (ii) a VL comprising a VL CDR1, a VL CDR2, and a VL CDR3 having an amino acid sequence of a VL CDR1, VL CDR2, and VL CDR3, respectively, of SEQ ID NO:8. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:9. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:10. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:9; and (ii) a VL comprising a VL CDR1, a VL CDR2, and a VL CDR3 having an amino acid sequence of a VL CDR1, VL CDR2, and VL CDR3, respectively, of SEQ ID NO:10. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:19. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:22. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:22. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:19. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:23. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:23. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:19. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:24. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:19; and (ii) a VL comprising a VL CDR1, a VL CDR2, and a VL CDR3 having an amino acid sequence of a VL CDR1, VL CDR2, and VL CDR3, respectively, of SEQ ID NO:24. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:20. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:22. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:20; and (ii) a VL comprising a VL CDR1, a VL CDR2, and a VL CDR3 having an amino acid sequence of a VL CDR1, VL CDR2, and VL CDR3, respectively, of SEQ ID NO:22. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:20. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:23. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:20. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:24. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:20; and (ii) a VL comprising a VL CDR1, a VL CDR2, and a VL CDR3 having an amino acid sequence of a VL CDR1, VL CDR2, and VL CDR3, respectively, of SEQ ID NO:24. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:21. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:22. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:22. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:21. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:23. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:23. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:21. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:24. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:24. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:46. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:49. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:46; and (ii) a VL comprising a VL CDR1, a VL CDR2, and a VL CDR3 having an amino acid sequence of a VL CDR1, VL CDR2, and VL CDR3, respectively, of SEQ ID NO:49. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:77. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:78. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:77; and (ii) a VL comprising a VL CDR1, a VL CDR2, and a VL CDR3 having an amino acid sequence of a VL CDR1, VL CDR2, and VL CDR3, respectively, of SEQ ID NO:78. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:79. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:80. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:79; and (ii) a VL comprising a VL CDR1, a VL CDR2, and a VL CDR3 having an amino acid sequence of a VL CDR1, VL CDR2, and VL CDR3, respectively, of SEQ ID NO:80. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:81. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:82. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:81; and (ii) a VL comprising a VL CDR1, a VL CDR2, and a VL CDR3 having an amino acid sequence of a VL CDR1, VL CDR2, and VL CDR3, respectively, of SEQ ID NO:82. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:83. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:84. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:83; and (ii) a VL comprising a VL CDR1, a VL CDR2, and a VL CDR3 having an amino acid sequence of a VL CDR1, VL CDR2, and VL CDR3, respectively, of SEQ ID NO:84. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:85. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:86. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:85; and (ii) a VL comprising a VL CDR1, a VL CDR2, and a VL CDR3 having an amino acid sequence of a VL CDR1, VL CDR2, and VL CDR3, respectively, of SEQ ID NO:86. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:87. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:88. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:87; and (ii) a VL comprising a VL CDR1, a VL CDR2, and a VL CDR3 having an amino acid sequence of a VL CDR1, VL CDR2, and VL CDR3, respectively, of SEQ ID NO:88. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:1000. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:1001. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:1000; and (ii) a VL comprising a VL CDR1, a VL CDR2, and a VL CDR3 having an amino acid sequence of a VL CDR1, VL CDR2, and VL CDR3, respectively, of SEQ ID NO:1001. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:1032. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:1033. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:1032; and (ii) a VL comprising a VL CDR1, a VL CDR2, and a VL CDR3 having an amino acid sequence of a VL CDR1, VL CDR2, and VL CDR3, respectively, of SEQ ID NO:1033. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:1064. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:1065. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:1064; and (ii) a VL comprising a VL CDR1, a VL CDR2, and a VL CDR3 having an amino acid sequence of a VL CDR1, VL CDR2, and VL CDR3, respectively, of SEQ ID NO:1065. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:1096. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:1097. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:1096; and (ii) a VL comprising a VL CDR1, a VL CDR2, and a VL CDR3 having an amino acid sequence of a VL CDR1, VL CDR2, and VL CDR3, respectively, of SEQ ID NO:1097. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:1128. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:1129. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:1128; and (ii) a VL comprising a VL CDR1, a VL CDR2, and a VL CDR3 having an amino acid sequence of a VL CDR1, VL CDR2, and VL CDR3, respectively, of SEQ ID NO:1129. In one embodiment, the first binding domain that binds to Vβ17 comprises a VH comprising a VH CDR1, a VH CDR2, and a VH CDR3 having an amino acid sequence of a VH CDR1, VH CDR2, and VH CDR3, respectively, of SEQ ID NO:21. In one embodiment, the first binding domain that binds to Vβ17 comprises a VL CDR1, a VL CDR2, and a VL CDR3 having an amino acid sequence of a VL CDR1, VL CDR2, and VL CDR3, respectively, of SEQ ID NO:677. In one embodiment, the first binding domain that binds to Vβ17 comprises: (i) a VH comprising a VH CDR1, a VH CDR2, and a VH CDR3 having an amino acid sequence of a VH CDR1, VH CDR2, and VH CDR3, respectively, of SEQ ID NO:21; and (ii) a VL comprising a VL CDR1, a VL CDR2, and a VL CDR3 having an amino acid sequence of a VL CDR1, VL CDR2, and VL CDR3, respectively, of SEQ ID NO:677. In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system.

In one embodiment, the first binding domain that binds to Vβ17, comprises: (i) a VH comprising a VH CDR1 having an amino acid sequence of SEQ ID NO:973, a VH CDR2 having an amino acid sequence of SEQ ID NO:974, and a VH CDR3 having an amino acid sequence of SEQ ID NO:975; and (ii) a VL comprising a VL CDR1 having an amino acid sequence of SEQ ID NO:988, a VL CDR2 having an amino acid sequence of SEQ ID NO:989, and a VL CDR3 having an amino acid sequence of SEQ ID NO:990. In one embodiment, the first binding domain that binds to Vβ17, comprises: (i) a VH comprising a VH CDR1 having an amino acid sequence of SEQ ID NO:976, a VH CDR2 having an amino acid sequence of SEQ ID NO:977, and a VH CDR3 having an amino acid sequence of SEQ ID NO:978; and (ii) a VL comprising a VL CDR1 having an amino acid sequence of SEQ ID NO:991, a VL CDR2 having an amino acid sequence of SEQ ID NO:992, and a VL CDR3 having an amino acid sequence of SEQ ID NO:993. In one embodiment, the first binding domain that binds to Vβ17, comprises: (i) a VH comprising a VH CDR1 having an amino acid sequence of SEQ ID NO:970, a VH CDR2 having an amino acid sequence of SEQ ID NO:971, and a VH CDR3 having an amino acid sequence of SEQ ID NO:972; and (ii) a VL comprising a VL CDR1 having an amino acid sequence of SEQ ID NO:985, a VL CDR2 having an amino acid sequence of SEQ ID NO:986, and a VL CDR3 having an amino acid sequence of SEQ ID NO:987. In one embodiment, the first binding domain that binds to Vβ17, comprises: (i) a VH comprising a VH CDR1 having an amino acid sequence of SEQ ID NO:982, a VH CDR2 having an amino acid sequence of SEQ ID NO:983, and a VH CDR3 having an amino acid sequence of SEQ ID NO:984; and (ii) a VL comprising a VL CDR1 having an amino acid sequence of SEQ ID NO:997, a VL CDR2 having an amino acid sequence of SEQ ID NO:998, and a VL CDR3 having an amino acid sequence of SEQ ID NO:999. In one embodiment, the first binding domain that binds to Vβ17, comprises: (i) a VH comprising a VH CDR1 having an amino acid sequence of SEQ ID NO:979, a VH CDR2 having an amino acid sequence of SEQ ID NO:980, and a VH CDR3 having an amino acid sequence of SEQ ID NO:981; and (ii) a VL comprising a VL CDR1 having an amino acid sequence of SEQ ID NO:994, a VL CDR2 having an amino acid sequence of SEQ ID NO:995, and a VL CDR3 having an amino acid sequence of SEQ ID NO:996. In one embodiment, the first binding domain that binds to Vβ17, comprises a VH comprising a VH CDR1, a VH CDR2, and a VH CDR3 having an amino acid sequence of a VH CDR1, VH CDR2, and VH CDR3, respectively, of SEQ ID NO:1000. In one embodiment, the first binding domain that binds to Vβ17, comprises a VL comprising a VL CDR1, a VL CDR2, and a VL CDR3 having an amino acid sequence of a VL CDR1, VL CDR2, and VL CDR3, respectively, of SEQ ID NO:1001. In one embodiment, the first binding domain that binds to Vβ17, comprises: (i) a VH comprising a VH CDR1, a VH CDR2, and a VH CDR3 having an amino acid sequence of a VH CDR1, VH CDR2, and VH CDR3, respectively, of SEQ ID NO:1000; and (ii) a VL comprising a VL CDR1, a VL CDR2, and a VL CDR3 having an amino acid sequence of a VL CDR1, VL CDR2, and VL CDR3, respectively, of SEQ ID NO:1001. In some embodiments, the first binding domain that binds to Vβ17, comprises a VH having an amino acid sequence of SEQ ID NO:1000. In some embodiments, the first binding domain that binds to Vβ17, comprises a VL having an amino acid sequence of SEQ ID NO:1001. In some embodiments, the first binding domain that binds to Vβ17, comprises a VH having an amino acid sequence of SEQ ID NO:1000, and a VL having an amino acid sequence of SEQ ID NO:1001. In some embodiments, the first binding domain that binds to Vβ17, comprises a VH having an amino acid sequence having at least 95% identity to an amino acid sequence of SEQ ID NO:1000. In some embodiments, the first binding domain that binds to Vβ17, comprises a VL having an amino acid sequence having at least 95% identity to an amino acid sequence of SEQ ID NO:1001. In some embodiments, the first binding domain that binds to Vβ17, comprises a VH having an amino acid sequence having at least 95% identity to an amino acid sequence of SEQ ID NO:1000, and a VL having an amino acid sequence having at least 95% identity to an amino acid sequence of SEQ ID NO:1001.

In one embodiment, the first binding domain that binds to Vβ17, comprises: (i) a VH comprising a VH CDR1 having an amino acid sequence of SEQ ID NO:1005, a VH CDR2 having an amino acid sequence of SEQ ID NO:1006, and a VH CDR3 having an amino acid sequence of SEQ ID NO:1007; and (ii) a VL comprising a VL CDR1 having an amino acid sequence of SEQ ID NO:1020, a VL CDR2 having an amino acid sequence of SEQ ID NO:1021, and a VL CDR3 having an amino acid sequence of SEQ ID NO:1022. In one embodiment, the first binding domain that binds to Vβ17, comprises: (i) a VH comprising a VH CDR1 having an amino acid sequence of SEQ ID NO:1008, a VH CDR2 having an amino acid sequence of SEQ ID NO:1009, and a VH CDR3 having an amino acid sequence of SEQ ID NO:1010; and (ii) a VL comprising a VL CDR1 having an amino acid sequence of SEQ ID NO:1023, a VL CDR2 having an amino acid sequence of SEQ ID NO:1024, and a VL CDR3 having an amino acid sequence of SEQ ID NO:1025. In one embodiment, the first binding domain that binds to Vβ17, comprises: (i) a VH comprising a VH CDR1 having an amino acid sequence of SEQ ID NO:1002, a VH CDR2 having an amino acid sequence of SEQ ID NO:1003, and a VH CDR3 having an amino acid sequence of SEQ ID NO:1004; and (ii) a VL comprising a VL CDR1 having an amino acid sequence of SEQ ID NO:1017, a VL CDR2 having an amino acid sequence of SEQ ID NO:1018, and a VL CDR3 having an amino acid sequence of SEQ ID NO:1019. In one embodiment, the first binding domain that binds to Vβ17, comprises: (i) a VH comprising a VH CDR1 having an amino acid sequence of SEQ ID NO:1014, a VH CDR2 having an amino acid sequence of SEQ ID NO:1015, and a VH CDR3 having an amino acid sequence of SEQ ID NO:1016; and (ii) a VL comprising a VL CDR1 having an amino acid sequence of SEQ ID NO:1029, a VL CDR2 having an amino acid sequence of SEQ ID NO:1030, and a VL CDR3 having an amino acid sequence of SEQ ID NO:1031. In one embodiment, the first binding domain that binds to Vβ17, comprises: (i) a VH comprising a VH CDR1 having an amino acid sequence of SEQ ID NO:1011, a VH CDR2 having an amino acid sequence of SEQ ID NO:1012, and a VH CDR3 having an amino acid sequence of SEQ ID NO:1013; and (ii) a VL comprising a VL CDR1 having an amino acid sequence of SEQ ID NO:1026, a VL CDR2 having an amino acid sequence of SEQ ID NO:1027, and a VL CDR3 having an amino acid sequence of SEQ ID NO:1028. In one embodiment, the first binding domain that binds to Vβ17, comprises a VH comprising a VH CDR1, a VH CDR2, and a VH CDR3 having an amino acid sequence of a VH CDR1, VH CDR2, and VH CDR3, respectively, of SEQ ID NO:1032. In one embodiment, the first binding domain that binds to Vβ17, comprises a VL comprising a VL CDR1, a VL CDR2, and a VL CDR3 having an amino acid sequence of a VL CDR1, VL CDR2, and VL CDR3, respectively, of SEQ ID NO:1033. In one embodiment, the first binding domain that binds to Vβ17, comprises: (i) a VH comprising a VH CDR1, a VH CDR2, and a VH CDR3 having an amino acid sequence of a VH CDR1, VH CDR2, and VH CDR3, respectively, of SEQ ID NO:1032; and (ii) a VL comprising a VL CDR1, a VL CDR2, and a VL CDR3 having an amino acid sequence of a VL CDR1, VL CDR2, and VL CDR3, respectively, of SEQ ID NO:1033. In some embodiments, the first binding domain that binds to Vβ17, comprises a VH having an amino acid sequence of SEQ ID NO:1032. In some embodiments, the first binding domain that binds to Vβ17, comprises a VL having an amino acid sequence of SEQ ID NO:1033. In some embodiments, the first binding domain that binds to Vβ17, comprises a VH having an amino acid sequence of SEQ ID NO:1032, and a VL having an amino acid sequence of SEQ ID NO:1033. In some embodiments, the first binding domain that binds to Vβ17, comprises a VH having an amino acid sequence having at least 95% identity to an amino acid sequence of SEQ ID NO:1032. In some embodiments, the first binding domain that binds to Vβ17, comprises a VL having an amino acid sequence having at least 95% identity to an amino acid sequence of SEQ ID NO:1033. In some embodiments, the first binding domain that binds to Vβ17, comprises a VH having an amino acid sequence having at least 95% identity to an amino acid sequence of SEQ ID NO:1032, and a VL having an amino acid sequence having at least 95% identity to an amino acid sequence of SEQ ID NO:1033.

In one embodiment, the first binding domain that binds to Vβ17, comprises: (i) a VH comprising a VH CDR1 having an amino acid sequence of SEQ ID NO:1037, a VH CDR2 having an amino acid sequence of SEQ ID NO:1038, and a VH CDR3 having an amino acid sequence of SEQ ID NO:1039; and (ii) a VL comprising a VL CDR1 having an amino acid sequence of SEQ ID NO:1052, a VL CDR2 having an amino acid sequence of SEQ ID NO:1053, and a VL CDR3 having an amino acid sequence of SEQ ID NO:1054. In one embodiment, the first binding domain that binds to Vβ17, comprises: (i) a VH comprising a VH CDR1 having an amino acid sequence of SEQ ID NO:1040, a VH CDR2 having an amino acid sequence of SEQ ID NO:1041, and a VH CDR3 having an amino acid sequence of SEQ ID NO:1042; and (ii) a VL comprising a VL CDR1 having an amino acid sequence of SEQ ID NO:1055, a VL CDR2 having an amino acid sequence of SEQ ID NO:1056, and a VL CDR3 having an amino acid sequence of SEQ ID NO:1057. In one embodiment, the first binding domain that binds to Vβ17, comprises: (i) a VH comprising a VH CDR1 having an amino acid sequence of SEQ ID NO:1034, a VH CDR2 having an amino acid sequence of SEQ ID NO:1035, and a VH CDR3 having an amino acid sequence of SEQ ID NO:1036; and (ii) a VL comprising a VL CDR1 having an amino acid sequence of SEQ ID NO:1049, a VL CDR2 having an amino acid sequence of SEQ ID NO:1050, and a VL CDR3 having an amino acid sequence of SEQ ID NO:1051. In one embodiment, the first binding domain that binds to Vβ17, comprises: (i) a VH comprising a VH CDR1 having an amino acid sequence of SEQ ID NO:1046, a VH CDR2 having an amino acid sequence of SEQ ID NO:1047, and a VH CDR3 having an amino acid sequence of SEQ ID NO:1048; and (ii) a VL comprising a VL CDR1 having an amino acid sequence of SEQ ID NO:1061, a VL CDR2 having an amino acid sequence of SEQ ID NO:1062, and a VL CDR3 having an amino acid sequence of SEQ ID NO:1063. In one embodiment, the first binding domain that binds to Vβ17, comprises: (i) a VH comprising a VH CDR1 having an amino acid sequence of SEQ ID NO:1043, a VH CDR2 having an amino acid sequence of SEQ ID NO:1044, and a VH CDR3 having an amino acid sequence of SEQ ID NO:1045; and (ii) a VL comprising a VL CDR1 having an amino acid sequence of SEQ ID NO:1058, a VL CDR2 having an amino acid sequence of SEQ ID NO:1059, and a VL CDR3 having an amino acid sequence of SEQ ID NO:1060. In one embodiment, the first binding domain that binds to Vβ17, comprises a VH comprising a VH CDR1, a VH CDR2, and a VH CDR3 having an amino acid sequence of a VH CDR1, VH CDR2, and VH CDR3, respectively, of SEQ ID NO:1064. In one embodiment, the first binding domain that binds to Vβ17, comprises a VL comprising a VL CDR1, a VL CDR2, and a VL CDR3 having an amino acid sequence of a VL CDR1, VL CDR2, and VL CDR3, respectively, of SEQ ID NO:1065. In one embodiment, the first binding domain that binds to Vβ17, comprises: (i) a VH comprising a VH CDR1, a VH CDR2, and a VH CDR3 having an amino acid sequence of a VH CDR1, VH CDR2, and VH CDR3, respectively, of SEQ ID NO:1064; and (ii) a VL comprising a VL CDR1, a VL CDR2, and a VL CDR3 having an amino acid sequence of a VL CDR1, VL CDR2, and VL CDR3, respectively, of SEQ ID NO:1065. In some embodiments, the first binding domain that binds to Vβ17, comprises a VH having an amino acid sequence of SEQ ID NO:1064. In some embodiments, the first binding domain that binds to Vβ17, comprises a VL having an amino acid sequence of SEQ ID NO:1065. In some embodiments, the first binding domain that binds to Vβ17, comprises a VH having an amino acid sequence of SEQ ID NO:1064, and a VL having an amino acid sequence of SEQ ID NO:1065. In some embodiments, the first binding domain that binds to Vβ17, comprises a VH having an amino acid sequence having at least 95% identity to an amino acid sequence of SEQ ID NO:1064. In some embodiments, the first binding domain that binds to Vβ17, comprises a VL having an amino acid sequence having at least 95% identity to an amino acid sequence of SEQ ID NO:1065. In some embodiments, the first binding domain that binds to Vβ17, comprises a VH having an amino acid sequence having at least 95% identity to an amino acid sequence of SEQ ID NO:1064, and a VL having an amino acid sequence having at least 95% identity to an amino acid sequence of SEQ ID NO:1065.

In one embodiment, the first binding domain that binds to Vβ17, comprises: (i) a VH comprising a VH CDR1 having an amino acid sequence of SEQ ID NO:1069, a VH CDR2 having an amino acid sequence of SEQ ID NO:1070, and a VH CDR3 having an amino acid sequence of SEQ ID NO:1071; and (ii) a VL comprising a VL CDR1 having an amino acid sequence of SEQ ID NO:1084, a VL CDR2 having an amino acid sequence of SEQ ID NO:1085, and a VL CDR3 having an amino acid sequence of SEQ ID NO:1086. In one embodiment, the first binding domain that binds to Vβ17, comprises: (i) a VH comprising a VH CDR1 having an amino acid sequence of SEQ ID NO:1072, a VH CDR2 having an amino acid sequence of SEQ ID NO:1073, and a VH CDR3 having an amino acid sequence of SEQ ID NO:1074; and (ii) a VL comprising a VL CDR1 having an amino acid sequence of SEQ ID NO:1087, a VL CDR2 having an amino acid sequence of SEQ ID NO:1088, and a VL CDR3 having an amino acid sequence of SEQ ID NO:1089. In one embodiment, the first binding domain that binds to Vβ17, comprises: (i) a VH comprising a VH CDR1 having an amino acid sequence of SEQ ID NO:1066, a VH CDR2 having an amino acid sequence of SEQ ID NO:1067, and a VH CDR3 having an amino acid sequence of SEQ ID NO:1068; and (ii) a VL comprising a VL CDR1 having an amino acid sequence of SEQ ID NO:1081, a VL CDR2 having an amino acid sequence of SEQ ID NO:1082, and a VL CDR3 having an amino acid sequence of SEQ ID NO:1083. In one embodiment, the first binding domain that binds to Vβ17, comprises: (i) a VH comprising a VH CDR1 having an amino acid sequence of SEQ ID NO:1078, a VH CDR2 having an amino acid sequence of SEQ ID NO:1079, and a VH CDR3 having an amino acid sequence of SEQ ID NO:1080; and (ii) a VL comprising a VL CDR1 having an amino acid sequence of SEQ ID NO:1093, a VL CDR2 having an amino acid sequence of SEQ ID NO:1094, and a VL CDR3 having an amino acid sequence of SEQ ID NO:1095. In one embodiment, the first binding domain that binds to Vβ17, comprises: (i) a VH comprising a VH CDR1 having an amino acid sequence of SEQ ID NO:1075, a VH CDR2 having an amino acid sequence of SEQ ID NO:1076, and a VH CDR3 having an amino acid sequence of SEQ ID NO:1077; and (ii) a VL comprising a VL CDR1 having an amino acid sequence of SEQ ID NO:1090, a VL CDR2 having an amino acid sequence of SEQ ID NO:1091, and a VL CDR3 having an amino acid sequence of SEQ ID NO:1092. In one embodiment, the first binding domain that binds to Vβ17, comprises a VH comprising a VH CDR1, a VH CDR2, and a VH CDR3 having an amino acid sequence of a VH CDR1, VH CDR2, and VH CDR3, respectively, of SEQ ID NO:1096. In one embodiment, the first binding domain that binds to Vβ17, comprises a VL comprising a VL CDR1, a VL CDR2, and a VL CDR3 having an amino acid sequence of a VL CDR1, VL CDR2, and VL CDR3, respectively, of SEQ ID NO:1097. In one embodiment, the first binding domain that binds to Vβ17, comprises: (i) a VH comprising a VH CDR1, a VH CDR2, and a VH CDR3 having an amino acid sequence of a VH CDR1, VH CDR2, and VH CDR3, respectively, of SEQ ID NO:1096; and (ii) a VL comprising a VL CDR1, a VL CDR2, and a VL CDR3 having an amino acid sequence of a VL CDR1, VL CDR2, and VL CDR3, respectively, of SEQ ID NO:1097. In some embodiments, the first binding domain that binds to Vβ17, comprises a VH having an amino acid sequence of SEQ ID NO:1096. In some embodiments, the first binding domain that binds to Vβ17, comprises a VL having an amino acid sequence of SEQ ID NO:1097. In some embodiments, the first binding domain that binds to Vβ17, comprises a VH having an amino acid sequence of SEQ ID NO:1096, and a VL having an amino acid sequence of SEQ ID NO:1097. In some embodiments, the first binding domain that binds to Vβ17, comprises a VH having an amino acid sequence having at least 95% identity to an amino acid sequence of SEQ ID NO:1096. In some embodiments, the first binding domain that binds to Vβ17, comprises a VL having an amino acid sequence having at least 95% identity to an amino acid sequence of SEQ ID NO:1097. In some embodiments, the first binding domain that binds to Vβ17, comprises a VH having an amino acid sequence having at least 95% identity to an amino acid sequence of SEQ ID NO:1096, and a VL having an amino acid sequence having at least 95% identity to an amino acid sequence of SEQ ID NO:1097.

In one embodiment, the first binding domain that binds to Vβ17, comprises: (i) a VH comprising a VH CDR1 having an amino acid sequence of SEQ ID NO:1101, a VH CDR2 having an amino acid sequence of SEQ ID NO:1102, and a VH CDR3 having an amino acid sequence of SEQ ID NO:1103; and (ii) a VL comprising a VL CDR1 having an amino acid sequence of SEQ ID NO:1116, a VL CDR2 having an amino acid sequence of SEQ ID NO:1117, and a VL CDR3 having an amino acid sequence of SEQ ID NO:1118. In one embodiment, the first binding domain that binds to Vβ17, comprises: (i) a VH comprising a VH CDR1 having an amino acid sequence of SEQ ID NO:1104, a VH CDR2 having an amino acid sequence of SEQ ID NO:1105, and a VH CDR3 having an amino acid sequence of SEQ ID NO:1106; and (ii) a VL comprising a VL CDR1 having an amino acid sequence of SEQ ID NO:1119, a VL CDR2 having an amino acid sequence of SEQ ID NO:1120, and a VL CDR3 having an amino acid sequence of SEQ ID NO:1121. In one embodiment, the first binding domain that binds to Vβ17, comprises: (i) a VH comprising a VH CDR1 having an amino acid sequence of SEQ ID NO:1098, a VH CDR2 having an amino acid sequence of SEQ ID NO:1099, and a VH CDR3 having an amino acid sequence of SEQ ID NO:1100; and (ii) a VL comprising a VL CDR1 having an amino acid sequence of SEQ ID NO:1113, a VL CDR2 having an amino acid sequence of SEQ ID NO:1114, and a VL CDR3 having an amino acid sequence of SEQ ID NO:1115. In one embodiment, the first binding domain that binds to Vβ17, comprises: (i) a VH comprising a VH CDR1 having an amino acid sequence of SEQ ID NO:1110, a VH CDR2 having an amino acid sequence of SEQ ID NO:1111, and a VH CDR3 having an amino acid sequence of SEQ ID NO:1112; and (ii) a VL comprising a VL CDR1 having an amino acid sequence of SEQ ID NO:1125, a VL CDR2 having an amino acid sequence of SEQ ID NO:1126, and a VL CDR3 having an amino acid sequence of SEQ ID NO:1127. In one embodiment, the first binding domain that binds to Vβ17, comprises: (i) a VH comprising a VH CDR1 having an amino acid sequence of SEQ ID NO:1107, a VH CDR2 having an amino acid sequence of SEQ ID NO:1108, and a VH CDR3 having an amino acid sequence of SEQ ID NO:1109; and (ii) a VL comprising a VL CDR1 having an amino acid sequence of SEQ ID NO:1122, a VL CDR2 having an amino acid sequence of SEQ ID NO:1123, and a VL CDR3 having an amino acid sequence of SEQ ID NO:1124. In one embodiment, the first binding domain that binds to Vβ17, comprises a VH comprising a VH CDR1, a VH CDR2, and a VH CDR3 having an amino acid sequence of a VH CDR1, VH CDR2, and VH CDR3, respectively, of SEQ ID NO:1128. In one embodiment, the first binding domain that binds to Vβ17, comprises a VL comprising a VL CDR1, a VL CDR2, and a VL CDR3 having an amino acid sequence of a VL CDR1, VL CDR2, and VL CDR3, respectively, of SEQ ID NO:1129. In one embodiment, the first binding domain that binds to Vβ17, comprises: (i) a VH comprising a VH CDR1, a VH CDR2, and a VH CDR3 having an amino acid sequence of a VH CDR1, VH CDR2, and VH CDR3, respectively, of SEQ ID NO:1128; and (ii) a VL comprising a VL CDR1, a VL CDR2, and a VL CDR3 having an amino acid sequence of a VL CDR1, VL CDR2, and VL CDR3, respectively, of SEQ ID NO:1129. In some embodiments, the first binding domain that binds to Vβ17, comprises a VH having an amino acid sequence of SEQ ID NO:1128. In some embodiments, the first binding domain that binds to Vβ17, comprises a VL having an amino acid sequence of SEQ ID NO:1129. In some embodiments, the first binding domain that binds to Vβ17, comprises a VH having an amino acid sequence of SEQ ID NO:1128, and a VL having an amino acid sequence of SEQ ID NO:1129. In some embodiments, the first binding domain that binds to Vβ17, comprises a VH having an amino acid sequence having at least 95% identity to an amino acid sequence of SEQ ID NO:1128. In some embodiments, the first binding domain that binds to Vβ17, comprises a VL having an amino acid sequence having at least 95% identity to an amino acid sequence of SEQ ID NO:1129. In some embodiments, the first binding domain that binds to Vβ17, comprises a VH having an amino acid sequence having at least 95% identity to an amino acid sequence of SEQ ID NO:1128, and a VL having an amino acid sequence having at least 95% identity to an amino acid sequence of SEQ ID NO:1129. In some embodiments, the first binding domain that binds Vβ17 comprises a VH having an amino acid sequence of SEQ ID NO:25. In some embodiments, the first binding domain comprises a VL having an amino acid sequence of SEQ ID NO:26. In some embodiments, the first binding domain comprises a VH having an amino acid sequence of SEQ ID NO:25, and a VL having an amino acid sequence of SEQ ID NO:26. In some embodiments, the first binding domain comprises a heavy chain having an amino acid sequence of SEQ ID NO:7. In some embodiments, the first binding domain comprises a light chain having an amino acid sequence of SEQ ID NO:8. In some embodiments, the first binding domain comprises a heavy chain having an amino acid sequence of SEQ ID NO:7, and a light chain having an amino acid sequence of SEQ ID NO:8. In some embodiments, the first binding domain comprises a heavy chain having an amino acid sequence of SEQ ID NO:9. In some embodiments, the first binding domain comprises a light chain having an amino acid sequence of SEQ ID NO:10. In some embodiments, the first binding domain comprises a heavy chain having an amino acid sequence of SEQ ID NO:9, and a light chain having an amino acid sequence of SEQ ID NO:10. In some embodiments, the first binding domain comprises a VH having an amino acid sequence having at least 95% identity to an amino acid sequence of SEQ ID NO:25. In some embodiments, the first binding domain comprises a VL having an amino acid sequence having at least 95% identity to an amino acid sequence of SEQ ID NO:26. In some embodiments, the first binding domain comprises a VH having an amino acid sequence having at least 95% identity to an amino acid sequence of SEQ ID NO:25, and a VL having an amino acid sequence having at least 95% identity to an amino acid sequence of SEQ ID NO:26. In some embodiments, the first binding domain comprises a heavy chain having an amino acid sequence having at least 95% identity to an amino acid sequence of SEQ ID NO:7. In some embodiments, the first binding domain comprises a light chain having an amino acid sequence having at least 95% identity to an amino acid sequence of SEQ ID NO:8. In some embodiments, the first binding domain comprises a heavy chain having an amino acid sequence having at least 95% identity to an amino acid sequence of SEQ ID NO:7, and a light chain having an amino acid sequence having at least 95% identity to an amino acid sequence of SEQ ID NO:8. In some embodiments, the first binding domain comprises a heavy chain having an amino acid sequence having at least 95% identity to an amino acid sequence of SEQ ID NO:9. In some embodiments, the first binding domain comprises a light chain having an amino acid sequence having at least 95% identity to an amino acid sequence of SEQ ID NO:10. In some embodiments, the first binding domain comprises a heavy chain having an amino acid sequence having at least 95% identity to an amino acid sequence of SEQ ID NO:9, and a light chain having an amino acid sequence having at least 95% identity to an amino acid sequence of SEQ ID NO:10. In some embodiments, the first binding domain comprises a VH having an amino acid sequence of SEQ ID NO:19. In some embodiments, the first binding domain comprises a VL having an amino acid sequence of SEQ ID NO:22. In some embodiments, the first binding domain comprises a VH having an amino acid sequence of SEQ ID NO:19, and a VL having an amino acid sequence of SEQ ID NO:22. In some embodiments, the first binding domain comprises a VH having an amino acid sequence having at least 95% identity to an amino acid sequence of SEQ ID NO:19. In some embodiments, the first binding domain comprises a VL having an amino acid sequence having at least 95% identity to an amino acid sequence of SEQ ID NO:22. In some embodiments, the first binding domain comprises a VH having an amino acid sequence having at least 95% identity to an amino acid sequence of SEQ ID NO:19, and a VL having an amino acid sequence having at least 95% identity to an amino acid sequence of SEQ ID NO:22. In some embodiments, the first binding domain comprises a VH having an amino acid sequence of SEQ ID NO:19. In some embodiments, the first binding domain comprises a VL having an amino acid sequence of SEQ ID NO:23. In some embodiments, the first binding domain comprises a VH having an amino acid sequence of SEQ ID NO:19, and a VL having an amino acid sequence of SEQ ID NO:23. In some embodiments, the first binding domain comprises a VH having an amino acid sequence having at least 95% identity to an amino acid sequence of SEQ ID NO:19. In some embodiments, the first binding domain comprises a VL having an amino acid sequence having at least 95% identity to an amino acid sequence of SEQ ID NO:23. In some embodiments, the first binding domain comprises a VH having an amino acid sequence having at least 95% identity to an amino acid sequence of SEQ ID NO:19, and a VL having an amino acid sequence having at least 95% identity to an amino acid sequence of SEQ ID NO:23. In some embodiments, the first binding domain comprises a VH having an amino acid sequence of SEQ ID NO:19. In some embodiments, the first binding domain comprises a VL having an amino acid sequence of SEQ ID NO:24. In some embodiments, the first binding domain comprises a VH having an amino acid sequence of SEQ ID NO:19, and a VL having a n amino acid sequence of SEQ ID NO:24. In some embodiments, the first binding domain comprises a VH having an amino acid sequence having at least 95% identity to an amino acid sequence of SEQ ID NO:19. In some embodiments, the first binding domain comprises a VL having an amino acid sequence having at least 95% identity to an amino acid sequence of SEQ ID NO:24. In some embodiments, the first binding domain comprises a VH having an amino acid sequence having at least 95% identity to an amino acid sequence of SEQ ID NO:19, and a VL having a n amino acid sequence of SEQ ID NO:24. In some embodiments, the first binding domain comprises a VH having an amino acid sequence of SEQ ID NO:20. In some embodiments, the first binding domain comprises a VL having an amino acid sequence of SEQ ID NO:22. In some embodiments, the first binding domain comprises a VH having an amino acid sequence of SEQ ID NO:20, and a VL having an amino acid sequence of SEQ ID NO:22. In some embodiments, the first binding domain comprises a VH having an amino acid sequence having at least 95% identity to an amino acid sequence of SEQ ID NO:20. In some embodiments, the first binding domain comprises a VL having an amino acid sequence having at least 95% identity to an amino acid sequence of SEQ ID NO:22. In some embodiments, the first binding domain comprises a VH having an amino acid sequence having at least 95% identity to an amino acid sequence of SEQ ID NO:20, and a VL having an amino acid sequence having at least 95% identity to an amino acid sequence of SEQ ID NO:22. In some embodiments, the first binding domain comprises a VH having an amino acid sequence of SEQ ID NO:20. In some embodiments, the first binding domain comprises a VL having an amino acid sequence of SEQ ID NO:23. In some embodiments, the first binding domain comprises a VH having an amino acid sequence of SEQ ID NO:20, and a VL having an amino acid sequence of SEQ ID NO:23. In some embodiments, the first binding domain comprises a VH having an amino acid sequence having at least 95% identity to an amino acid sequence of SEQ ID NO:20. In some embodiments, the first binding domain comprises a VL having an amino acid sequence having at least 95% identity to an amino acid sequence of SEQ ID NO:23. In some embodiments, the first binding domain comprises a VH having an amino acid sequence having at least 95% identity to an amino acid sequence of SEQ ID NO:20, and a VL having an amino acid sequence having at least 95% identity to an amino acid sequence of SEQ ID NO:23. In some embodiments, the first binding domain comprises a VH having an amino acid sequence of SEQ ID NO:20. In some embodiments, the first binding domain comprises a VL having an amino acid sequence of SEQ ID NO:24. In some embodiments, the first binding domain comprises a VH having an amino acid sequence of SEQ ID NO:20, and a VL having an amino acid sequence of SEQ ID NO:24. In some embodiments, the first binding domain comprises a VH having an amino acid sequence having at least 95% identity to an amino acid sequence of SEQ ID NO:20. In some embodiments, the first binding domain comprises a VL having an amino acid sequence having at least 95% identity to an amino acid sequence of SEQ ID NO:24. In some embodiments, the first binding domain comprises a VH having an amino acid sequence having at least 95% identity to an amino acid sequence of SEQ ID NO:20, and a VL having an amino acid sequence having at least 95% identity to an amino acid sequence of SEQ ID NO:24. In some embodiments, the first binding domain comprises a VL having an amino acid sequence of SEQ ID NO:22. In some embodiments, the first binding domain comprises a VH having an amino acid sequence of SEQ ID NO:21, and a VL having an amino acid sequence of SEQ ID NO:22. In some embodiments, the first binding domain comprises a VH having an amino acid sequence having at least 95% identity to an amino acid sequence of SEQ ID NO:21. In some embodiments, the first binding domain comprises a VL having an amino acid sequence having at least 95% identity to an amino acid sequence of SEQ ID NO:22. In some embodiments, the first binding domain comprises a VH having an amino acid sequence having at least 95% identity to an amino acid sequence of SEQ ID NO:21, and a VL having an amino acid sequence having at least 95% identity to an amino acid sequence of SEQ ID NO:22. In some embodiments, the first binding domain comprises a VH having an amino acid sequence of SEQ ID NO:21. In some embodiments, the first binding domain comprises a VL having an amino acid sequence of SEQ ID NO:24. In some embodiments, the first binding domain comprises a VH having an amino acid sequence of SEQ ID NO:21, and a VL having an amino acid sequence of SEQ ID NO:24. In some embodiments, the first binding domain comprises a VH having an amino acid sequence having at least 95% identity to an amino acid sequence of SEQ ID NO:21. In some embodiments, the first binding domain comprises a VL having an amino acid sequence having at least 95% identity to an amino acid sequence of SEQ ID NO:24. In some embodiments, the first binding domain comprises a VH having an amino acid sequence having at least 95% identity to an amino acid sequence of SEQ ID NO:21, and a VL having an amino acid sequence having at least 95% identity to an amino acid sequence of SEQ ID NO:24. In some embodiments, the first binding domain comprises a heavy chain having an amino acid sequence of SEQ ID NO:11. In some embodiments, the first binding domain comprises a light chain having an amino acid sequence of SEQ ID NO:12. In some embodiments, the first binding domain comprises a heavy chain having an amino acid sequence having at least 95% identity to an amino acid sequence of SEQ ID NO:11, and a light chain having an amino acid sequence having at least 95% identity to an amino acid sequence of SEQ ID NO:12. In some embodiments, the first binding domain comprises a VH having an amino acid sequence having at least 95% identity to an amino acid sequence of SEQ ID NO:46. In some embodiments, the first binding domain comprises a VL having an amino acid sequence having at least 95% identity to an amino acid sequence of SEQ ID NO:47. In some embodiments, the first binding domain comprises a VH having an amino acid sequence having at least 95% identity to an amino acid sequence of SEQ ID NO:46, and a VL having an amino acid sequence having at least 95% identity to an amino acid sequence of SEQ ID NO:47. In some embodiments, the first binding domain comprises a heavy chain having an amino acid sequence having at least 95% identity to an amino acid sequence of SEQ ID NO:11. In some embodiments, the first binding domain comprises a light chain having an amino acid sequence having at least 95% identity to an amino acid sequence of SEQ ID NO:12. In some embodiments, the first binding domain comprises a heavy chain having an amino acid sequence having at least 95% identity to an amino acid sequence of SEQ ID NO:11, and a light chain having an amino acid sequence having at least 95% identity to an amino acid sequence of SEQ ID NO:12. In some embodiments, the first binding domain comprises a VH having an amino acid sequence having at least 95% identity to an amino acid sequence of SEQ ID NO:77. In some embodiments, the first binding domain comprises a VL having an amino acid sequence having at least 95% identity to an amino acid sequence of SEQ ID NO:78. In some embodiments, the first binding domain comprises a VH having an amino acid sequence having at least 95% identity to an amino acid sequence of SEQ ID NO:77, and a VL having an amino acid sequence having at least 95% identity to an amino acid sequence of SEQ ID NO:78. In some embodiments, the first binding domain comprises a heavy chain having an amino acid sequence having at least 95% identity to an amino acid sequence of SEQ ID NO:664. In some embodiments, the first binding domain comprises a light chain having an amino acid sequence having at least 95% identity to an amino acid sequence of SEQ ID NO:665. In some embodiments, the first binding domain comprises a heavy chain having an amino acid sequence having at least 95% identity to an amino acid sequence of SEQ ID NO:664, and a light chain having an amino acid sequence having at least 95% identity to an amino acid sequence of SEQ ID NO:665. In some embodiments, the first binding domain comprises a VH having an amino acid sequence of SEQ ID NO:79. In some embodiments, the first binding domain comprises a VL having an amino acid sequence of SEQ ID NO:80. In some embodiments, the first binding domain comprises a VH having an amino acid sequence of SEQ ID NO:79, and a VL having an amino acid sequence of SEQ ID NO:80. In some embodiments, the first binding domain comprises a heavy chain having an amino acid sequence of SEQ ID NO:666. In some embodiments, the first binding domain comprises a light chain having an amino acid sequence of SEQ ID NO:667. In some embodiments, the first binding domain comprises a heavy chain having an amino acid sequence of SEQ ID NO:666, and a light chain having an amino acid sequence of SEQ ID NO:667. In some embodiments, the first binding domain comprises a VH having an amino acid sequence having at least 95% identity to an amino acid sequence of SEQ ID NO:79. In some embodiments, the first binding domain comprises a VL having an amino acid sequence having at least 95% identity to an amino acid sequence of SEQ ID NO:80. In some embodiments, the first binding domain comprises a VH having an amino acid sequence having at least 95% identity to an amino acid sequence of SEQ ID NO:79, and a VL having an amino acid sequence having at least 95% identity to an amino acid sequence of SEQ ID NO:80. In some embodiments, the first binding domain comprises a heavy chain having an amino acid sequence having at least 95% identity to an amino acid sequence of SEQ ID NO:666. In some embodiments, the first binding domain comprises a light chain having an amino acid sequence having at least 95% identity to an amino acid sequence of SEQ ID NO:667. In some embodiments, the first binding domain comprises a heavy chain having an amino acid sequence having at least 95% identity to an amino acid sequence of SEQ ID NO:666, and a light chain having an amino acid sequence having at least 95% identity to an amino acid sequence of SEQ ID NO:667. In some embodiments, the first binding domain comprises a VH having an amino acid sequence of SEQ ID NO:81. In some embodiments, the first binding domain comprises a VL having an amino acid sequence of SEQ ID NO:82. In some embodiments, the first binding domain comprises a VH having an amino acid sequence of SEQ ID NO:81, and a VL having an amino acid sequence of SEQ ID NO:82. In some embodiments, the first binding domain comprises a heavy chain having an amino acid sequence of SEQ ID NO:668. In some embodiments, the first binding domain comprises a light chain having an amino acid sequence of SEQ ID NO:669. In some embodiments, the first binding domain comprises a heavy chain having an amino acid sequence of SEQ ID NO:668, and a light chain having an amino acid sequence of SEQ ID NO:669. In some embodiments, the first binding domain comprises a VH having an amino acid sequence having at least 95% identity to an amino acid sequence of SEQ ID NO:81. In some embodiments, the first binding domain comprises a VL having an amino acid sequence having at least 95% identity to an amino acid sequence of SEQ ID NO:82. In some embodiments, the first binding domain comprises a VH having an amino acid sequence having at least 95% identity to an amino acid sequence of SEQ ID NO:81, and a VL having an amino acid sequence having at least 95% identity to an amino acid sequence of SEQ ID NO:82. In some embodiments, the first binding domain comprises a heavy chain having an amino acid sequence having at least 95% identity to an amino acid sequence of SEQ ID NO:668. In some embodiments, the first binding domain comprises a light chain having an amino acid sequence having at least 95% identity to an amino acid sequence of SEQ ID NO:669. In some embodiments, the first binding domain comprises a heavy chain having an amino acid sequence having at least 95% identity to an amino acid sequence of SEQ ID NO:668, and a light chain having an amino acid sequence having at least 95% identity to an amino acid sequence of SEQ ID NO:669. In some embodiments, the first binding domain comprises a VH having an amino acid sequence of SEQ ID NO:83. In some embodiments, the first binding domain comprises a VL having an amino acid sequence of SEQ ID NO:84. In some embodiments, the first binding domain comprises a VH having an amino acid sequence of SEQ ID NO:83, and a VL having an amino acid sequence of SEQ ID NO:84. In some embodiments, the first binding domain comprises a heavy chain having an amino acid sequence of SEQ ID NO:670. In some embodiments, the first binding domain comprises a light chain having an amino acid sequence of SEQ ID NO:671. In some embodiments, the first binding domain comprises a heavy chain having an amino acid sequence of SEQ ID NO:670, and a light chain having an amino acid sequence of SEQ ID NO:671. In some embodiments, the first binding domain comprises a VH having an amino acid sequence having at least 95% identity to an amino acid sequence of SEQ ID NO:83. In some embodiments, the first binding domain comprises a VL having an amino acid sequence having at least 95% identity to an amino acid sequence of SEQ ID NO:84. In some embodiments, the first binding domain comprises a VH having an amino acid sequence having at least 95% identity to an amino acid sequence of SEQ ID NO:83, and a VL having an amino acid sequence having at least 95% identity to an amino acid sequence of SEQ ID NO:84. In some embodiments, the first binding domain comprises a heavy chain having an amino acid sequence having at least 95% identity to an amino acid sequence of SEQ ID NO:670. In some embodiments, the first binding domain comprises a light chain having an amino acid sequence having at least 95% identity to an amino acid sequence of SEQ ID NO:671. In some embodiments, the first binding domain comprises a heavy chain having an amino acid sequence having at least 95% identity to an amino acid sequence of SEQ ID NO:670, and a light chain having an amino acid sequence having at least 95% identity to an amino acid sequence of SEQ ID NO:671. In some embodiments, the first binding domain comprises a VH having an amino acid sequence of SEQ ID NO:85. In some embodiments, the first binding domain comprises a VL having an amino acid sequence of SEQ ID NO:86. In some embodiments, the first binding domain comprises a VH having an amino acid sequence of SEQ ID NO:85, and a VL having an amino acid sequence of SEQ ID NO:86. In some embodiments, the first binding domain comprises a heavy chain having an amino acid sequence of SEQ ID NO:672. In some embodiments, the first binding domain comprises a light chain having an amino acid sequence of SEQ ID NO:673. In some embodiments, the first binding domain comprises a heavy chain having an amino acid sequence of SEQ ID NO:672, and a light chain having an amino acid sequence of SEQ ID NO:673. In some embodiments, the first binding domain comprises a VH having an amino acid sequence having at least 95% identity to an amino acid sequence of SEQ ID NO:85. In some embodiments, the first binding domain comprises a VL having an amino acid sequence having at least 95% identity to an amino acid sequence of SEQ ID NO:86. In some embodiments, the first binding domain comprises a VH having an amino acid sequence having at least 95% identity to an amino acid sequence of SEQ ID NO:85, and a VL having an amino acid sequence having at least 95% identity to an amino acid sequence of SEQ ID NO:86. In some embodiments, the first binding domain comprises a heavy chain having an amino acid sequence having at least 95% identity to an amino acid sequence of SEQ ID NO:672. In some embodiments, the first binding domain comprises a light chain having an amino acid sequence having at least 95% identity to an amino acid sequence of SEQ ID NO:673. In some embodiments, the first binding domain comprises a heavy chain having an amino acid sequence having at least 95% identity to an amino acid sequence of SEQ ID NO:672, and a light chain having an amino acid sequence having at least 95% identity to an amino acid sequence of SEQ ID NO:673. In some embodiments, the first binding domain comprises a VH having an amino acid sequence of SEQ ID NO:87. In some embodiments, the first binding domain comprises a VL having an amino acid sequence of SEQ ID NO:88. In some embodiments, the first binding domain comprises a VH having an amino acid sequence of SEQ ID NO:87, and a VL having an amino acid sequence of SEQ ID NO:88. In some embodiments, the first binding domain comprises a heavy chain having an amino acid sequence of SEQ ID NO:674. In some embodiments, the first binding domain comprises a light chain having an amino acid sequence of SEQ ID NO:675. In some embodiments, the first binding domain comprises a heavy chain having an amino acid sequence of SEQ ID NO:674, and a light chain having an amino acid sequence of SEQ ID NO:675. In some embodiments, the first binding domain comprises a VH having an amino acid sequence having at least 95% identity to an amino acid sequence of SEQ ID NO:87. In some embodiments, the first binding domain comprises a VL having an amino acid sequence having at least 95% identity to an amino acid sequence of SEQ ID NO:88. In some embodiments, the first binding domain comprises a VH having an amino acid sequence having at least 95% identity to an amino acid sequence of SEQ ID NO:87, and a VL having an amino acid sequence having at least 95% identity to an amino acid sequence of SEQ ID NO:88. In some embodiments, the first binding domain comprises a heavy chain having an amino acid sequence having at least 95% identity to an amino acid sequence of SEQ ID NO:674. In some embodiments, the first binding domain comprises a light chain having an amino acid sequence having at least 95% identity to an amino acid sequence of SEQ ID NO:675. In some embodiments, the first binding domain comprises a heavy chain having an amino acid sequence having at least 95% identity to an amino acid sequence of SEQ ID NO:674, and a light chain having an amino acid sequence having at least 95% identity to an amino acid sequence of SEQ ID NO:675. In some embodiments, the first binding domain comprises a VH having an amino acid sequence of SEQ ID NO:21. In some embodiments, the first binding domain comprises a VL having an amino acid sequence of SEQ ID NO:665. In some embodiments, the first binding domain comprises a VH having an amino acid sequence of SEQ ID NO:21, and a VL having an amino acid sequence of SEQ ID NO:665. In some embodiments, the first binding domain comprises a VH having an amino acid sequence having at least 95% identity to an amino acid sequence of SEQ ID NO:21. In some embodiments, the first binding domain comprises a VL having an amino acid sequence having at least 95% identity to an amino acid sequence of SEQ ID NO:665. In some embodiments, the first binding domain comprises a VH having an amino acid sequence having at least 95% identity to an amino acid sequence of SEQ ID NO:21, and a VL having an amino acid sequence having at least 95% identity to an amino acid sequence of SEQ ID NO:665. In some embodiments, the first binding domain comprises a heavy chain having an amino acid sequence of SEQ ID NO:1000. In some embodiments, the first binding domain comprises a light chain having an amino acid sequence of SEQ ID NO:1001. In some embodiments, the first binding domain comprises a heavy chain having an amino acid sequence having an amino acid sequence of SEQ ID NO:1000, and a light chain having an amino acid sequence having an amino acid sequence of SEQ ID NO:1001. In some embodiments, the first binding domain comprises a heavy chain having an amino acid sequence having at least 95% identity to an amino acid sequence of SEQ ID NO:1000. In some embodiments, the first binding domain comprises a light chain having an amino acid sequence having at least 95% identity to an amino acid sequence of SEQ ID NO:1001. In some embodiments, the first binding domain comprises a heavy chain having an amino acid sequence having at least 95% identity to an amino acid sequence of SEQ ID NO:1000, and a light chain having an amino acid sequence having at least 95% identity to an amino acid sequence of SEQ ID NO:1001. In some embodiments, the first binding domain comprises a heavy chain having an amino acid sequence of SEQ ID NO:1032. In some embodiments, the first binding domain comprises a light chain having an amino acid sequence of SEQ ID NO:1033. In some embodiments, the first binding domain comprises a heavy chain having an amino acid sequence having an amino acid sequence of SEQ ID NO:1032, and a light chain having an amino acid sequence having an amino acid sequence of SEQ ID NO:1033. In some embodiments, the first binding domain comprises a heavy chain having an amino acid sequence having at least 95% identity to an amino acid sequence of SEQ ID NO:1032. In some embodiments, the first binding domain comprises a light chain having an amino acid sequence having at least 95% identity to an amino acid sequence of SEQ ID NO:1033. In some embodiments, the first binding domain comprises a heavy chain having an amino acid sequence having at least 95% identity to an amino acid sequence of SEQ ID NO:1032, and a light chain having an amino acid sequence having at least 95% identity to an amino acid sequence of SEQ ID NO:1033. In some embodiments, the first binding domain comprises a heavy chain having an amino acid sequence of SEQ ID NO:1064. In some embodiments, the first binding domain comprises a light chain having an amino acid sequence of SEQ ID NO:1065. In some embodiments, the first binding domain comprises a heavy chain having an amino acid sequence having an amino acid sequence of SEQ ID NO:1064, and a light chain having an amino acid sequence having an amino acid sequence of SEQ ID NO:1065. In some embodiments, the first binding domain comprises a heavy chain having an amino acid sequence having at least 95% identity to an amino acid sequence of SEQ ID NO:1064. In some embodiments, the first binding domain comprises a light chain having an amino acid sequence having at least 95% identity to an amino acid sequence of SEQ ID NO:1065. In some embodiments, the first binding domain comprises a heavy chain having an amino acid sequence having at least 95% identity to an amino acid sequence of SEQ ID NO:1064, and a light chain having an amino acid sequence having at least 95% identity to an amino acid sequence of SEQ ID NO:1065. In some embodiments, the first binding domain comprises a heavy chain having an amino acid sequence of SEQ ID NO:1096. In some embodiments, the first binding domain comprises a light chain having an amino acid sequence of SEQ ID NO:1097. In some embodiments, the first binding domain comprises a heavy chain having an amino acid sequence having an amino acid sequence of SEQ ID NO:1096, and a light chain having an amino acid sequence having an amino acid sequence of SEQ ID NO:1097. In some embodiments, the first binding domain comprises a heavy chain having an amino acid sequence having at least 95% identity to an amino acid sequence of SEQ ID NO:1096. In some embodiments, the first binding domain comprises a light chain having an amino acid sequence having at least 95% identity to an amino acid sequence of SEQ ID NO:1097. In some embodiments, the first binding domain comprises a heavy chain having an amino acid sequence having at least 95% identity to an amino acid sequence of SEQ ID NO:1096, and a light chain having an amino acid sequence having at least 95% identity to an amino acid sequence of SEQ ID NO:1097. In some embodiments, the first binding domain comprises a heavy chain having an amino acid sequence of SEQ ID NO:1128. In some embodiments, the first binding domain comprises a light chain having an amino acid sequence of SEQ ID NO:1129. In some embodiments, the first binding domain comprises a heavy chain having an amino acid sequence having an amino acid sequence of SEQ ID NO:1128, and a light chain having an amino acid sequence having an amino acid sequence of SEQ ID NO:1129. In some embodiments, the first binding domain comprises a heavy chain having an amino acid sequence having at least 95% identity to an amino acid sequence of SEQ ID NO:1128. In some embodiments, the first binding domain comprises a light chain having an amino acid sequence having at least 95% identity to an amino acid sequence of SEQ ID NO:1129. In some embodiments, the first binding domain comprises a heavy chain having an amino acid sequence having at least 95% identity to an amino acid sequence of SEQ ID NO:1128, and a light chain having an amino acid sequence having at least 95% identity to an amino acid sequence of SEQ ID NO:1129.

In another aspect, provided herein is a multispecific antibody comprising: (a) a first binding domain that binds to Vβ17, and (b) a second binding domain that binds to a second target that is not Vβ17. In some embodiments, the first binding domain comprises VH CDR1, VH CDR2, VH CDR3, VL CDR1, VL CDR2 and VL CDR3 amino acid sequences of a Vβ17 antibody provided herein. In other embodiments, the first binding domain comprises VH and VL amino acid sequences of a Vβ17 antibody provided herein. In some embodiments, the multispecific antibody is a bispecific antibody.

In some embodiments, the second target is CD123. Thus, in another aspect, provided herein is a multispecific antibody comprising: (a) a first binding domain that binds to Vβ17, and (b) a second binding domain that binds to CD123. In some embodiments, the multispecific antibody is a bispecific antibody. In some embodiments, the first binding domain comprises the VH CDR1, VH CDR, and VH CDR3 amino acid sequences of a Vβ17 antibody provided herein. In some embodiments, the first binding domain comprises the VL CDR1, VL CDR2 and VL CDR3 amino acid sequences of a Vβ17 antibody provided herein. In some embodiments, the first binding domain comprises the VH CDR1, VH CDR2, VH CDR3, VL CDR1, VL CDR2 and VL CDR3 amino acid sequences of a Vβ17 antibody provided herein. In other embodiments, the first binding domain that binds to Vβ17 comprises a VH amino acid sequence of a Vβ17 antibody provided herein. In other embodiments, the first binding domain that binds to Vβ17 comprises a VL amino acid sequence of a Vβ17 antibody provided herein. In other embodiments, the first binding domain that binds to Vβ17 comprises VH and VL amino acid sequences of a Vβ17 antibody provided herein. In some embodiments, the second binding domain that binds to CD123 comprises VH CDR1, VH CDR2, VH CDR3, VL CDR1, VL CDR2 and VL CDR3 amino acid sequences of a CD123 antibody provided herein. In other embodiments, the second binding domain that binds to CD123 comprises a VH amino acid sequence of a CD123 antibody provided herein. In other embodiments, the second binding domain that binds to CD123 comprises a VL amino acid sequence of a CD123 antibody provided herein. In other embodiments, the second binding domain comprises VH and VL amino acid sequences of a CD123 antibody provided herein. In some embodiments, the second binding domain that binds to CD123 comprises: (i) a VH comprising a VH CDR1 having an amino acid sequence of SEQ ID NO:34, a VH CDR2 having an amino acid sequence of SEQ ID NO:35, and a VH CDR3 having an amino acid sequence of SEQ ID NO:36; and (ii) a VL comprising a VL CDR1 having an amino acid sequence of SEQ ID NO:37, a VL CDR2 having an amino acid sequence of SEQ ID NO:38, and a VL CDR3 having an amino acid sequence of SEQ ID NO:39. In some embodiments, the second binding domain comprises: (i) a VH comprising a VH CDR1 having an amino acid sequence of SEQ ID NO:580, a VH CDR2 having an amino acid sequence of SEQ ID NO:581, and a VH CDR3 having an amino acid sequence of SEQ ID NO:582; and (ii) a VL comprising a VL CDR1 having an amino acid sequence of SEQ ID NO:583, a VL CDR2 having an amino acid sequence of SEQ ID NO:584, and a VL CDR3 having an amino acid sequence of SEQ ID NO:585. In some embodiments, the second binding domain comprises: (i) a VH comprising a VH CDR1 having an amino acid sequence of SEQ ID NO:586, a VH CDR2 having an amino acid sequence of SEQ ID NO:587, and a VH CDR3 having an amino acid sequence of SEQ ID NO:588; and (ii) a VL comprising a VL CDR1 having an amino acid sequence of SEQ ID NO:589, a VL CDR2 having an amino acid sequence of SEQ ID NO:590, and a VL CDR3 having an amino acid sequence of SEQ ID NO:591. In some embodiments, the second binding domain comprises: (i) a VH comprising a VH CDR1 having an amino acid sequence of SEQ ID NO:592, a VH CDR2 having an amino acid sequence of SEQ ID NO:593, and a VH CDR3 having an amino acid sequence of SEQ ID NO:594; and (ii) a VL comprising a VL CDR1 having an amino acid sequence of SEQ ID NO:595, a VL CDR2 having an amino acid sequence of SEQ ID NO:596, and a VL CDR3 having an amino acid sequence of SEQ ID NO:597. In some embodiments, the second binding domain comprises: (i) a VH comprising a VH CDR1 having an amino acid sequence of SEQ ID NO:598, a VH CDR2 having an amino acid sequence of SEQ ID NO:599, and a VH CDR3 having an amino acid sequence of SEQ ID NO:600; and (ii) a VL comprising a VL CDR1 having an amino acid sequence of SEQ ID NO:601, a VL CDR2 having an amino acid sequence of SEQ ID NO:602, and a VL CDR3 having an amino acid sequence of SEQ ID NO:603. In some embodiments, the second binding domain comprises: (i) a VH comprising a VH CDR1 having an amino acid sequence of SEQ ID NO:604, a VH CDR2 having an amino acid sequence of SEQ ID NO:605, and a VH CDR3 having an amino acid sequence of SEQ ID NO:606; and (ii) a VL comprising a VL CDR1 having an amino acid sequence of SEQ ID NO:607, a VL CDR2 having an amino acid sequence of SEQ ID NO:608, and a VL CDR3 having an amino acid sequence of SEQ ID NO:609. In some embodiments, the second binding domain comprises: (i) a VH comprising a VH CDR1 having an amino acid sequence of SEQ ID NO:610, a VH CDR2 having an amino acid sequence of SEQ ID NO:611, and a VH CDR3 having an amino acid sequence of SEQ ID NO:612; and (ii) a VL comprising a VL CDR1 having an amino acid sequence of SEQ ID NO:613, a VL CDR2 having an amino acid sequence of SEQ ID NO:614, and a VL CDR3 having an amino acid sequence of SEQ ID NO:615. In some embodiments, the second binding domain comprises: (i) a VH comprising a VH CDR1 having an amino acid sequence of SEQ ID NO:616, a VH CDR2 having an amino acid sequence of SEQ ID NO:617, and a VH CDR3 having an amino acid sequence of SEQ ID NO:618; and (ii) a VL comprising a VL CDR1 having an amino acid sequence of SEQ ID NO:619, a VL CDR2 having an amino acid sequence of SEQ ID NO:620, and a VL CDR3 having an amino acid sequence of SEQ ID NO:621. In some embodiments, the second binding domain comprises a VH comprising a VH CDR1, a VH CDR2, and a VH CDR3 having an amino acid sequence of a VH CDR1, VH CDR2, and VH CDR3, respectively, of SEQ ID NO:40. In some embodiments, the second binding domain comprises a VL comprising a VL CDR1, a VL CDR2, and a VL CDR3 having an amino acid sequence of a VL CDR1, VL CDR2, and VL CDR3, respectively, of SEQ ID NO:41. In some embodiments, the second binding domain comprises: (i) a VH comprising a VH CDR1, a VH CDR2, and a VH CDR3 having an amino acid sequence of a VH CDR1, VH CDR2, and VH CDR3, respectively, of SEQ ID NO:40; and (ii) a VL comprising a VL CDR1, a VL CDR2, and a VL CDR3 having an amino acid sequence of a VL CDR1, VL CDR2, and VL CDR3, respectively, of SEQ ID NO:41. In some embodiments, the second binding domain comprises a VH having an amino acid sequence of SEQ ID NO:40. In some embodiments, the second binding domain comprises a VL having an amino acid sequence of SEQ ID NO:41. In some embodiments, the second binding domain comprises a VH having an amino acid sequence of SEQ ID NO:40, and a VL having an amino acid sequence of SEQ ID NO:41. In some embodiments, the second binding domain comprises a heavy chain having an amino acid sequence of SEQ ID NO:15. In some embodiments, the second binding domain comprises a light chain having an amino acid sequence of SEQ ID NO:16. In some embodiments, the second binding domain comprises a heavy chain having an amino acid sequence of SEQ ID NO:15, and a light chain having an amino acid sequence of SEQ ID NO:16. In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system.

In some embodiments, the second target is BCMA. Thus, in another aspect, provided herein is a multispecific antibody comprising: (a) a first binding domain that binds to Vβ17, and (b) a second binding domain that binds to BCMA. In some embodiments, the multispecific antibody is a bispecific antibody. In some embodiments, the first binding domain comprises the VH CDR1, VH CDR, and VH CDR3 amino acid sequences of a Vβ17 antibody provided herein. In some embodiments, the first binding domain comprises the VL CDR1, VL CDR2 and VL CDR3 amino acid sequences of a Vβ17 antibody provided herein. In some embodiments, the first binding domain comprises the VH CDR1, VH CDR2, VH CDR3, VL CDR1, VL CDR2 and VL CDR3 amino acid sequences of a Vβ17 antibody provided herein. In other embodiments, the first binding domain that binds to Vβ17 comprises a VH amino acid sequence of a Vβ17 antibody provided herein. In other embodiments, the first binding domain that binds to Vβ17 comprises a VL amino acid sequence of a Vβ17 antibody provided herein. In other embodiments, the first binding domain that binds to Vβ17 comprises VH and VL amino acid sequences of a Vβ17 antibody provided herein. In some embodiments, the second binding domain that binds to BCMA comprises VH CDR1, VH CDR2, VH CDR3, VL CDR1, VL CDR2 and VL CDR3 amino acid sequences of a BCMA antibody provided herein. In other embodiments, the second binding domain that binds to BCMA comprises a VH amino acid sequence of a BCMA antibody provided herein. In other embodiments, the second binding domain that binds to BCMA comprises a VL amino acid sequence of a BCMA antibody provided herein. In other embodiments, the second binding domain comprises VH and VL amino acid sequences of a BCMA antibody provided herein. In some embodiments, the second binding domain that binds to BCMA comprises: (i) a VH comprising a VH CDR1 having an amino acid sequence of SEQ ID NO:89, a VH CDR2 having an amino acid sequence of SEQ ID NO:90, and a VH CDR3 having an amino acid sequence of SEQ ID NO:91; and (ii) a VL comprising a VL CDR1 having an amino acid sequence of SEQ ID NO:93, a VL CDR2 having an amino acid sequence of SEQ ID NO:94, and a VL CDR3 having an amino acid sequence of SEQ ID NO:94. In some embodiments, the second binding domain comprises: (i) a VH comprising a VH CDR1 having an amino acid sequence of SEQ ID NO:622, a VH CDR2 having an amino acid sequence of SEQ ID NO:623, and a VH CDR3 having an amino acid sequence of SEQ ID NO:624; and (ii) a VL comprising a VL CDR1 having an amino acid sequence of SEQ ID NO:625, a VL CDR2 having an amino acid sequence of SEQ ID NO:626, and a VL CDR3 having an amino acid sequence of SEQ ID NO:627. In some embodiments, the second binding domain comprises: (i) a VH comprising a VH CDR1 having an amino acid sequence of SEQ ID NO:628, a VH CDR2 having an amino acid sequence of SEQ ID NO:629, and a VH CDR3 having an amino acid sequence of SEQ ID NO:630; and (ii) a VL comprising a VL CDR1 having an amino acid sequence of SEQ ID NO:631, a VL CDR2 having an amino acid sequence of SEQ ID NO:632, and a VL CDR3 having an amino acid sequence of SEQ ID NO:633. In some embodiments, the second binding domain comprises: (i) a VH comprising a VH CDR1 having an amino acid sequence of SEQ ID NO:634, a VH CDR2 having an amino acid sequence of SEQ ID NO:635, and a VH CDR3 having an amino acid sequence of SEQ ID NO:636; and (ii) a VL comprising a VL CDR1 having an amino acid sequence of SEQ ID NO:637, a VL CDR2 having an amino acid sequence of SEQ ID NO:638, and a VL CDR3 having an amino acid sequence of SEQ ID NO:639. In some embodiments, the second binding domain comprises: (i) a VH comprising a VH CDR1 having an amino acid sequence of SEQ ID NO:640, a VH CDR2 having an amino acid sequence of SEQ ID NO:641, and a VH CDR3 having an amino acid sequence of SEQ ID NO:642; and (ii) a VL comprising a VL CDR1 having an amino acid sequence of SEQ ID NO:643, a VL CDR2 having an amino acid sequence of SEQ ID NO:644, and a VL CDR3 having an amino acid sequence of SEQ ID NO:645. In some embodiments, the second binding domain comprises: (i) a VH comprising a VH CDR1 having an amino acid sequence of SEQ ID NO:646, a VH CDR2 having an amino acid sequence of SEQ ID NO:647, and a VH CDR3 having an amino acid sequence of SEQ ID NO:648; and (ii) a VL comprising a VL CDR1 having an amino acid sequence of SEQ ID NO:649, a VL CDR2 having an amino acid sequence of SEQ ID NO:650, and a VL CDR3 having an amino acid sequence of SEQ ID NO:651. In some embodiments, the second binding domain comprises: (i) a VH comprising a VH CDR1 having an amino acid sequence of SEQ ID NO:652, a VH CDR2 having an amino acid sequence of SEQ ID NO:653, and a VH CDR3 having an amino acid sequence of SEQ ID NO:654; and (ii) a VL comprising a VL CDR1 having an amino acid sequence of SEQ ID NO:655, a VL CDR2 having an amino acid sequence of SEQ ID NO:656, and a VL CDR3 having an amino acid sequence of SEQ ID NO:657. In some embodiments, the second binding domain comprises: (i) a VH comprising a VH CDR1 having an amino acid sequence of SEQ ID NO:658, a VH CDR2 having an amino acid sequence of SEQ ID NO:659, and a VH CDR3 having an amino acid sequence of SEQ ID NO:660; and (ii) a VL comprising a VL CDR1 having an amino acid sequence of SEQ ID NO:661, a VL CDR2 having an amino acid sequence of SEQ ID NO:662, and a VL CDR3 having an amino acid sequence of SEQ ID NO:663. In some embodiments, the second binding domain comprises a VH comprising a VH CDR1, a VH CDR2, and a VH CDR3 having an amino acid sequence of a VH CDR1, VH CDR2, and VH CDR3, respectively, of SEQ ID NO:95. In some embodiments, the second binding domain comprises a VL comprising a VL CDR1, a VL CDR2, and a VL CDR3 having an amino acid sequence of a VL CDR1, VL CDR2, and VL CDR3, respectively, of SEQ ID NO:96. In some embodiments, the second binding domain comprises: (i) a VH comprising a VH CDR1, a VH CDR2, and a VH CDR3 having an amino acid sequence of a VH CDR1, VH CDR2, and VH CDR3, respectively, of SEQ ID NO:95; and (ii) a VL comprising a VL CDR1, a VL CDR2, and a VL CDR3 having an amino acid sequence of a VL CDR1, VL CDR2, and VL CDR3, respectively, of SEQ ID NO:96. In some embodiments, the second binding domain comprises a VH having an amino acid sequence of SEQ ID NO:95. In some embodiments, the second binding domain comprises a VL having an amino acid sequence of SEQ ID NO:96. In some embodiments, the second binding domain comprises a VH having an amino acid sequence of SEQ ID NO:95, and a VL having an amino acid sequence of SEQ ID NO:96. In some embodiments, the second binding domain comprises a VH having an amino acid sequence having at least 95% identity to an amino acid sequence of SEQ ID NO:95. In some embodiments, the second binding domain comprises a VL having an amino acid sequence having at least 95% identity to an amino acid sequence of SEQ ID NO:96. In some embodiments, the second binding domain comprises a VH having an amino acid sequence having at least 95% identity to an amino acid sequence of SEQ ID NO:95, and a VL having an amino acid sequence having at least 95% identity to an amino acid sequence of SEQ ID NO:96. In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system.

In some embodiments, the second target is DLL3. Thus, in another aspect, provided herein is a multispecific antibody comprising: (a) a first binding domain that binds to Vβ17, and (b) a second binding domain that binds to DLL3. In some embodiments, the multispecific antibody is a bispecific antibody. In some embodiments, the first binding domain comprises the VH CDR1, VH CDR, and VH CDR3 amino acid sequences of a Vβ17 antibody provided herein. In some embodiments, the first binding domain comprises the VL CDR1, VL CDR2 and VL CDR3 amino acid sequences of a Vβ17 antibody provided herein. In some embodiments, the first binding domain comprises the VH CDR1, VH CDR2, VH CDR3, VL CDR1, VL CDR2 and VL CDR3 amino acid sequences of a Vβ17 antibody provided herein. In other embodiments, the first binding domain that binds to Vβ17 comprises a VH amino acid sequence of a Vβ17 antibody provided herein. In other embodiments, the first binding domain that binds to Vβ17 comprises a VL amino acid sequence of a Vβ17 antibody provided herein. In other embodiments, the first binding domain that binds to Vβ17 comprises VH and VL amino acid sequences of a Vβ17 antibody provided herein. In some embodiments, the second binding domain that binds to DLL3 comprises VH CDR1, VH CDR2, VH CDR3, VL CDR1, VL CDR2 and VL CDR3 amino acid sequences of a DLL3 antibody provided herein. In other embodiments, the second binding domain that binds to DLL3 comprises a VH amino acid sequence of a DLL3 antibody provided herein. In other embodiments, the second binding domain that binds to DLL3 comprises a VL amino acid sequence of a DLL3 antibody provided herein. In other embodiments, the second binding domain comprises VH and VL amino acid sequences of a DLL3 antibody provided herein. In some embodiments, the second binding domain that binds to DLL3 comprises: (i) a VH comprising a VH CDR1 having an amino acid sequence of SEQ ID NO:696, a VH CDR2 having an amino acid sequence of SEQ ID NO:697, and a VH CDR3 having an amino acid sequence of SEQ ID NO:698; and (ii) a VL comprising a VL CDR1 having an amino acid sequence of SEQ ID NO:699, a VL CDR2 having an amino acid sequence of SEQ ID NO:700, and a VL CDR3 having an amino acid sequence of SEQ ID NO:701. In some embodiments, the second binding domain comprises: (i) a VH comprising a VH CDR1, a VH CDR2, and a VH CDR3 having an amino acid sequence of a VH CDR1, VH CDR2, and VH CDR3, respectively, of SEQ ID NO:692; and (ii) a VL comprising a VL CDR1, a VL CDR2, and a VL CDR3 having an amino acid sequence of a VL CDR1, VL CDR2, and VL CDR3, respectively, of SEQ ID NO:693. In some embodiments, the second binding domain comprises a VH having an amino acid sequence of SEQ ID NO:692. In some embodiments, the second binding domain comprises a VL having an amino acid sequence of SEQ ID NO:693. In some embodiments, the second binding domain comprises a VH having an amino acid sequence of SEQ ID NO:692, and a VL having an amino acid sequence of SEQ ID NO:693. In some embodiments, the second binding domain comprises a VH having an amino acid sequence having at least 95% identity to an amino acid sequence of SEQ ID NO:692. In some embodiments, the second binding domain comprises a VL having an amino acid sequence having at least 95% identity to an amino acid sequence of SEQ ID NO:693. In some embodiments, the second binding domain comprises a VH having an amino acid sequence having at least 95% identity to an amino acid sequence of SEQ ID NO:692, and a VL having an amino acid sequence having at least 95% identity to an amino acid sequence of SEQ ID NO:693. In some embodiments, the second binding domain comprises a VH comprising a VH CDR1, a VH CDR2, and a VH CDR3 having an amino acid sequence of a VH CDR1, VH CDR2, and VH CDR3, respectively, of SEQ ID NO:694. In some embodiments, the second binding domain comprises a VL comprising a VL CDR1, a VL CDR2, and a VL CDR3 having an amino acid sequence of a VL CDR1, VL CDR2, and VL CDR3, respectively, of SEQ ID NO:695. In some embodiments, the second binding domain comprises: (i) a VH comprising a VH CDR1, a VH CDR2, and a VH CDR3 having an amino acid sequence of a VH CDR1, VH CDR2, and VH CDR3, respectively, of SEQ ID NO:694; and (ii) a VL comprising a VL CDR1, a VL CDR2, and a VL CDR3 having an amino acid sequence of a VL CDR1, VL CDR2, and VL CDR3, respectively, of SEQ ID NO:695. In some embodiments, the second binding domain comprises a VH having an amino acid sequence of SEQ ID NO:694. In some embodiments, the second binding domain comprises a VL having an amino acid sequence of SEQ ID NO:695. In some embodiments, the second binding domain comprises a VH having an amino acid sequence of SEQ ID NO:694, and a VL having an amino acid sequence of SEQ ID NO:695. In some embodiments, the second binding domain comprises a VH having an amino acid sequence having at least 95% identity to an amino acid sequence of SEQ ID NO:694. In some embodiments, the second binding domain comprises a VL having an amino acid sequence having at least 95% identity to an amino acid sequence of SEQ ID NO:695. In some embodiments, the second binding domain comprises a VH having an amino acid sequence having at least 95% identity to an amino acid sequence of SEQ ID NO:694, and a VL having an amino acid sequence having at least 95% identity to an amino acid sequence of SEQ ID NO:695. In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system.

In some embodiments, the second target is PSMA. Thus, in another aspect, provided herein is a multispecific antibody comprising: (a) a first binding domain that binds to Vβ17, and (b) a second binding domain that binds to PSMA. In some embodiments, the multispecific antibody is a bispecific antibody. In some embodiments, the first binding domain comprises the VH CDR1, VH CDR, and VH CDR3 amino acid sequences of a Vβ17 antibody provided herein. In some embodiments, the first binding domain comprises the VL CDR1, VL CDR2 and VL CDR3 amino acid sequences of a Vβ17 antibody provided herein. In some embodiments, the first binding domain comprises the VH CDR1, VH CDR2, VH CDR3, VL CDR1, VL CDR2 and VL CDR3 amino acid sequences of a Vβ17 antibody provided herein. In other embodiments, the first binding domain that binds to Vβ17 comprises a VH amino acid sequence of a Vβ17 antibody provided herein. In other embodiments, the first binding domain that binds to Vβ17 comprises a VL amino acid sequence of a Vβ17 antibody provided herein. In other embodiments, the first binding domain that binds to Vβ17 comprises VH and VL amino acid sequences of a Vβ17 antibody provided herein. In some embodiments, the second binding domain that binds to PSMA comprises VH CDR1, VH CDR2, VH CDR3, VL CDR1, VL CDR2 and VL CDR3 amino acid sequences of a PSMA antibody provided herein. In other embodiments, the second binding domain that binds to PSMA comprises a VH amino acid sequence of a PSMA antibody provided herein. In other embodiments, the second binding domain that binds to PSMA comprises a VL amino acid sequence of a PSMA antibody provided herein. In other embodiments, the second binding domain comprises VH and VL amino acid sequences of a PSMA antibody provided herein. In some embodiments, the second binding domain that binds to PSMA comprises: (i) a VH comprising a VH CDR1 having an amino acid sequence of SEQ ID NO:738, a VH CDR2 having an amino acid sequence of SEQ ID NO:739, and a VH CDR3 having an amino acid sequence of SEQ ID NO:740; and (ii) a VL comprising a VL CDR1 having an amino acid sequence of SEQ ID NO:741, a VL CDR2 having an amino acid sequence of SEQ ID NO:742, and a VL CDR3 having an amino acid sequence of SEQ ID NO:743. In some embodiments, the second binding domain comprises: (i) a VH comprising a VH CDR1 having an amino acid sequence of SEQ ID NO:762, a VH CDR2 having an amino acid sequence of SEQ ID NO:763, and a VH CDR3 having an amino acid sequence of SEQ ID NO:764; and (ii) a VL comprising a VL CDR1 having an amino acid sequence of SEQ ID NO:765, a VL CDR2 having an amino acid sequence of SEQ ID NO:766, and a VL CDR3 having an amino acid sequence of SEQ ID NO:767. In some embodiments, the second binding domain comprises: (i) a VH comprising a VH CDR1 having an amino acid sequence of SEQ ID NO:786, a VH CDR2 having an amino acid sequence of SEQ ID NO:787, and a VH CDR3 having an amino acid sequence of SEQ ID NO:788; and (ii) a VL comprising a VL CDR1 having an amino acid sequence of SEQ ID NO:789, a VL CDR2 having an amino acid sequence of SEQ ID NO:790, and a VL CDR3 having an amino acid sequence of SEQ ID NO:791. In some embodiments, the second binding domain comprises: (i) a VH comprising a VH CDR1 having an amino acid sequence of SEQ ID NO:810, a VH CDR2 having an amino acid sequence of SEQ ID NO:811, and a VH CDR3 having an amino acid sequence of SEQ ID NO:812; and (ii) a VL comprising a VL CDR1 having an amino acid sequence of SEQ ID NO:813, a VL CDR2 having an amino acid sequence of SEQ ID NO:814, and a VL CDR3 having an amino acid sequence of SEQ ID NO:815. In some embodiments, the second binding domain comprises: (i) a VH comprising a VH CDR1 having an amino acid sequence of SEQ ID NO:834, a VH CDR2 having an amino acid sequence of SEQ ID NO:835, and a VH CDR3 having an amino acid sequence of SEQ ID NO:836; and (ii) a VL comprising a VL CDR1 having an amino acid sequence of SEQ ID NO:837, a VL CDR2 having an amino acid sequence of SEQ ID NO:838, and a VL CDR3 having an amino acid sequence of SEQ ID NO:839. In some embodiments, the second binding domain comprises a VH comprising a VH CDR1, a VH CDR2, and a VH CDR3 having an amino acid sequence of a VH CDR1, VH CDR2, and VH CDR3, respectively, of SEQ ID NO:730. In some embodiments, the second binding domain comprises a VL comprising a VL CDR1, a VL CDR2, and a VL CDR3 having an amino acid sequence of a VL CDR1, VL CDR2, and VL CDR3, respectively, of SEQ ID NO:731. In some embodiments, the second binding domain comprises: (i) a VH comprising a VH CDR1, a VH CDR2, and a VH CDR3 having an amino acid sequence of a VH CDR1, VH CDR2, and VH CDR3, respectively, of SEQ ID NO:730; and (ii) a VL comprising a VL CDR1, a VL CDR2, and a VL CDR3 having an amino acid sequence of a VL CDR1, VL CDR2, and VL CDR3, respectively, of SEQ ID NO:731. In some embodiments, the second binding domain comprises a VH having an amino acid sequence of SEQ ID NO:730. In some embodiments, the second binding domain comprises a VL having an amino acid sequence of SEQ ID NO:731. In some embodiments, the second binding domain comprises a VH having an amino acid sequence of SEQ ID NO:730, and a VL having an amino acid sequence of SEQ ID NO:731. In some embodiments, the second binding domain comprises a VH having an amino acid sequence having at least 95% identity to an amino acid sequence of SEQ ID NO:730. In some embodiments, the second binding domain comprises a VL having an amino acid sequence having at least 95% identity to an amino acid sequence of SEQ ID NO:731. In some embodiments, the second binding domain comprises a VH having an amino acid sequence having at least 95% identity to an amino acid sequence of SEQ ID NO:730, and a VL having an amino acid sequence having at least 95% identity to an amino acid sequence of SEQ ID NO:731. In some embodiments, the second binding domain that binds to PSMA comprises: (i) a VH comprising a VH CDR1 having an amino acid sequence of SEQ ID NO:744, a VH CDR2 having an amino acid sequence of SEQ ID NO:745, and a VH CDR3 having an amino acid sequence of SEQ ID NO:746; and (ii) a VL comprising a VL CDR1 having an amino acid sequence of SEQ ID NO:747, a VL CDR2 having an amino acid sequence of SEQ ID NO:748, and a VL CDR3 having an amino acid sequence of SEQ ID NO:749. In some embodiments, the second binding domain comprises: (i) a VH comprising a VH CDR1 having an amino acid sequence of SEQ ID NO:768, a VH CDR2 having an amino acid sequence of SEQ ID NO:769, and a VH CDR3 having an amino acid sequence of SEQ ID NO:770; and (ii) a VL comprising a VL CDR1 having an amino acid sequence of SEQ ID NO:771, a VL CDR2 having an amino acid sequence of SEQ ID NO:772, and a VL CDR3 having an amino acid sequence of SEQ ID NO:773. In some embodiments, the second binding domain comprises: (i) a VH comprising a VH CDR1 having an amino acid sequence of SEQ ID NO:792, a VH CDR2 having an amino acid sequence of SEQ ID NO:793, and a VH CDR3 having an amino acid sequence of SEQ ID NO:794; and (ii) a VL comprising a VL CDR1 having an amino acid sequence of SEQ ID NO:795, a VL CDR2 having an amino acid sequence of SEQ ID NO:796, and a VL CDR3 having an amino acid sequence of SEQ ID NO:797. In some embodiments, the second binding domain comprises: (i) a VH comprising a VH CDR1 having an amino acid sequence of SEQ ID NO:816, a VH CDR2 having an amino acid sequence of SEQ ID NO:817, and a VH CDR3 having an amino acid sequence of SEQ ID NO:818; and (ii) a VL comprising a VL CDR1 having an amino acid sequence of SEQ ID NO:819, a VL CDR2 having an amino acid sequence of SEQ ID NO:820, and a VL CDR3 having an amino acid sequence of SEQ ID NO:821. In some embodiments, the second binding domain comprises: (i) a VH comprising a VH CDR1 having an amino acid sequence of SEQ ID NO:840, a VH CDR2 having an amino acid sequence of SEQ ID NO:841, and a VH CDR3 having an amino acid sequence of SEQ ID NO:842; and (ii) a VL comprising a VL CDR1 having an amino acid sequence of SEQ ID NO:843, a VL CDR2 having an amino acid sequence of SEQ ID NO:844, and a VL CDR3 having an amino acid sequence of SEQ ID NO:845. In some embodiments, the second binding domain comprises a VH comprising a VH CDR1, a VH CDR2, and a VH CDR3 having an amino acid sequence of a VH CDR1, VH CDR2, and VH CDR3, respectively, of SEQ ID NO:732. In some embodiments, the second binding domain comprises a VL comprising a VL CDR1, a VL CDR2, and a VL CDR3 having an amino acid sequence of a VL CDR1, VL CDR2, and VL CDR3, respectively, of SEQ ID NO:733. In some embodiments, the second binding domain comprises: (i) a VH comprising a VH CDR1, a VH CDR2, and a VH CDR3 having an amino acid sequence of a VH CDR1, VH CDR2, and VH CDR3, respectively, of SEQ ID NO:732; and (ii) a VL comprising a VL CDR1, a VL CDR2, and a VL CDR3 having an amino acid sequence of a VL CDR1, VL CDR2, and VL CDR3, respectively, of SEQ ID NO:733. In some embodiments, the second binding domain comprises a VH having an amino acid sequence of SEQ ID NO:732. In some embodiments, the second binding domain comprises a VL having an amino acid sequence of SEQ ID NO:733. In some embodiments, the second binding domain comprises a VH having an amino acid sequence of SEQ ID NO:732, and a VL having an amino acid sequence of SEQ ID NO:733. In some embodiments, the second binding domain comprises a VH having an amino acid sequence having at least 95% identity to an amino acid sequence of SEQ ID NO:732. In some embodiments, the second binding domain comprises a VL having an amino acid sequence having at least 95% identity to an amino acid sequence of SEQ ID NO:733. In some embodiments, the second binding domain comprises a VH having an amino acid sequence having at least 95% identity to an amino acid sequence of SEQ ID NO:732, and a VL having an amino acid sequence having at least 95% identity to an amino acid sequence of SEQ ID NO:733. In some embodiments, the second binding domain that binds to PSMA comprises: (i) a VH comprising a VH CDR1 having an amino acid sequence of SEQ ID NO:750, a VH CDR2 having an amino acid sequence of SEQ ID NO:751, and a VH CDR3 having an amino acid sequence of SEQ ID NO:752; and (ii) a VL comprising a VL CDR1 having an amino acid sequence of SEQ ID NO:753, a VL CDR2 having an amino acid sequence of SEQ ID NO:754, and a VL CDR3 having an amino acid sequence of SEQ ID NO:755. In some embodiments, the second binding domain comprises: (i) a VH comprising a VH CDR1 having an amino acid sequence of SEQ ID NO:774, a VH CDR2 having an amino acid sequence of SEQ ID NO:775, and a VH CDR3 having an amino acid sequence of SEQ ID NO:776; and (ii) a VL comprising a VL CDR1 having an amino acid sequence of SEQ ID NO:777, a VL CDR2 having an amino acid sequence of SEQ ID NO:778, and a VL CDR3 having an amino acid sequence of SEQ ID NO:779. In some embodiments, the second binding domain comprises: (i) a VH comprising a VH CDR1 having an amino acid sequence of SEQ ID NO:798, a VH CDR2 having an amino acid sequence of SEQ ID NO:799, and a VH CDR3 having an amino acid sequence of SEQ ID NO:800; and (ii) a VL comprising a VL CDR1 having an amino acid sequence of SEQ ID NO:801, a VL CDR2 having an amino acid sequence of SEQ ID NO:802, and a VL CDR3 having an amino acid sequence of SEQ ID NO:803. In some embodiments, the second binding domain comprises: (i) a VH comprising a VH CDR1 having an amino acid sequence of SEQ ID NO:822, a VH CDR2 having an amino acid sequence of SEQ ID NO:823, and a VH CDR3 having an amino acid sequence of SEQ ID NO:824; and (ii) a VL comprising a VL CDR1 having an amino acid sequence of SEQ ID NO:825, a VL CDR2 having an amino acid sequence of SEQ ID NO:826, and a VL CDR3 having an amino acid sequence of SEQ ID NO:827. In some embodiments, the second binding domain comprises: (i) a VH comprising a VH CDR1 having an amino acid sequence of SEQ ID NO:846, a VH CDR2 having an amino acid sequence of SEQ ID NO:847, and a VH CDR3 having an amino acid sequence of SEQ ID NO:848; and (ii) a VL comprising a VL CDR1 having an amino acid sequence of SEQ ID NO:849, a VL CDR2 having an amino acid sequence of SEQ ID NO:850, and a VL CDR3 having an amino acid sequence of SEQ ID NO:851. In some embodiments, the second binding domain comprises a VH comprising a VH CDR1, a VH CDR2, and a VH CDR3 having an amino acid sequence of a VH CDR1, VH CDR2, and VH CDR3, respectively, of SEQ ID NO:734. In some embodiments, the second binding domain comprises a VL comprising a VL CDR1, a VL CDR2, and a VL CDR3 having an amino acid sequence of a VL CDR1, VL CDR2, and VL CDR3, respectively, of SEQ ID NO:735. In some embodiments, the second binding domain comprises: (i) a VH comprising a VH CDR1, a VH CDR2, and a VH CDR3 having an amino acid sequence of a VH CDR1, VH CDR2, and VH CDR3, respectively, of SEQ ID NO:734; and (ii) a VL comprising a VL CDR1, a VL CDR2, and a VL CDR3 having an amino acid sequence of a VL CDR1, VL CDR2, and VL CDR3, respectively, of SEQ ID NO:735. In some embodiments, the second binding domain comprises a VH having an amino acid sequence of SEQ ID NO:734. In some embodiments, the second binding domain comprises a VL having an amino acid sequence of SEQ ID NO:735. In some embodiments, the second binding domain comprises a VH having an amino acid sequence of SEQ ID NO:734, and a VL having an amino acid sequence of SEQ ID NO:735. In some embodiments, the second binding domain comprises a VH having an amino acid sequence having at least 95% identity to an amino acid sequence of SEQ ID NO:734. In some embodiments, the second binding domain comprises a VL having an amino acid sequence having at least 95% identity to an amino acid sequence of SEQ ID NO:735. In some embodiments, the second binding domain comprises a VH having an amino acid sequence having at least 95% identity to an amino acid sequence of SEQ ID NO:734, and a VL having an amino acid sequence having at least 95% identity to an amino acid sequence of SEQ ID NO:735. In some embodiments, the second binding domain that binds to PSMA comprises: (i) a VH comprising a VH CDR1 having an amino acid sequence of SEQ ID NO:756, a VH CDR2 having an amino acid sequence of SEQ ID NO:757, and a VH CDR3 having an amino acid sequence of SEQ ID NO:758; and (ii) a VL comprising a VL CDR1 having an amino acid sequence of SEQ ID NO:759, a VL CDR2 having an amino acid sequence of SEQ ID NO:760, and a VL CDR3 having an amino acid sequence of SEQ ID NO:761. In some embodiments, the second binding domain comprises: (i) a VH comprising a VH CDR1 having an amino acid sequence of SEQ ID NO:780, a VH CDR2 having an amino acid sequence of SEQ ID NO:781, and a VH CDR3 having an amino acid sequence of SEQ ID NO:782; and (ii) a VL comprising a VL CDR1 having an amino acid sequence of SEQ ID NO:783, a VL CDR2 having an amino acid sequence of SEQ ID NO:784, and a VL CDR3 having an amino acid sequence of SEQ ID NO:785. In some embodiments, the second binding domain comprises: (i) a VH comprising a VH CDR1 having an amino acid sequence of SEQ ID NO:804, a VH CDR2 having an amino acid sequence of SEQ ID NO:805, and a VH CDR3 having an amino acid sequence of SEQ ID NO:806; and (ii) a VL comprising a VL CDR1 having an amino acid sequence of SEQ ID NO:807, a VL CDR2 having an amino acid sequence of SEQ ID NO:808, and a VL CDR3 having an amino acid sequence of SEQ ID NO:809. In some embodiments, the second binding domain comprises: (i) a VH comprising a VH CDR1 having an amino acid sequence of SEQ ID NO:828, a VH CDR2 having an amino acid sequence of SEQ ID NO:829, and a VH CDR3 having an amino acid sequence of SEQ ID NO:830; and (ii) a VL comprising a VL CDR1 having an amino acid sequence of SEQ ID NO:831, a VL CDR2 having an amino acid sequence of SEQ ID NO:832, and a VL CDR3 having an amino acid sequence of SEQ ID NO:833. In some embodiments, the second binding domain comprises: (i) a VH comprising a VH CDR1 having an amino acid sequence of SEQ ID NO:852, a VH CDR2 having an amino acid sequence of SEQ ID NO:853, and a VH CDR3 having an amino acid sequence of SEQ ID NO:854; and (ii) a VL comprising a VL CDR1 having an amino acid sequence of SEQ ID NO:855, a VL CDR2 having an amino acid sequence of SEQ ID NO:856, and a VL CDR3 having an amino acid sequence of SEQ ID NO:857. In some embodiments, the second binding domain comprises a VH comprising a VH CDR1, a VH CDR2, and a VH CDR3 having an amino acid sequence of a VH CDR1, VH CDR2, and VH CDR3, respectively, of SEQ ID NO:736. In some embodiments, the second binding domain comprises a VL comprising a VL CDR1, a VL CDR2, and a VL CDR3 having an amino acid sequence of a VL CDR1, VL CDR2, and VL CDR3, respectively, of SEQ ID NO:737. In some embodiments, the second binding domain comprises: (i) a VH comprising a VH CDR1, a VH CDR2, and a VH CDR3 having an amino acid sequence of a VH CDR1, VH CDR2, and VH CDR3, respectively, of SEQ ID NO:736; and (ii) a VL comprising a VL CDR1, a VL CDR2, and a VL CDR3 having an amino acid sequence of a VL CDR1, VL CDR2, and VL CDR3, respectively, of SEQ ID NO:737. In some embodiments, the second binding domain comprises a VH having an amino acid sequence of SEQ ID NO:736. In some embodiments, the second binding domain comprises a VL having an amino acid sequence of SEQ ID NO:737. In some embodiments, the second binding domain comprises a VH having an amino acid sequence of SEQ ID NO:736, and a VL having an amino acid sequence of SEQ ID NO:737. In some embodiments, the second binding domain comprises a VH having an amino acid sequence having at least 95% identity to an amino acid sequence of SEQ ID NO:736. In some embodiments, the second binding domain comprises a VL having an amino acid sequence having at least 95% identity to an amino acid sequence of SEQ ID NO:737. In some embodiments, the second binding domain comprises a VH having an amino acid sequence having at least 95% identity to an amino acid sequence of SEQ ID NO:736, and a VL having an amino acid sequence having at least 95% identity to an amino acid sequence of SEQ ID NO:737. In some embodiments, the second binding domain that binds to PSMA comprises: (i) a VH comprising a VH CDR1 having an amino acid sequence of SEQ ID NO:901, a VH CDR2 having an amino acid sequence of SEQ ID NO:902, and a VH CDR3 having an amino acid sequence of SEQ ID NO:903; and (ii) a VL comprising a VL CDR1 having an amino acid sequence of SEQ ID NO:904, a VL CDR2 having an amino acid sequence of SEQ ID NO:905, and a VL CDR3 having an amino acid sequence of SEQ ID NO:906. In some embodiments, the second binding domain comprises: (i) a VH comprising a VH CDR1 having an amino acid sequence of SEQ ID NO:907, a VH CDR2 having an amino acid sequence of SEQ ID NO:908, and a VH CDR3 having an amino acid sequence of SEQ ID NO:909; and (ii) a VL comprising a VL CDR1 having an amino acid sequence of SEQ ID NO:910, a VL CDR2 having an amino acid sequence of SEQ ID NO:911, and a VL CDR3 having an amino acid sequence of SEQ ID NO:912. In some embodiments, the second binding domain comprises: (i) a VH comprising a VH CDR1 having an amino acid sequence of SEQ ID NO:913, a VH CDR2 having an amino acid sequence of SEQ ID NO:914, and a VH CDR3 having an amino acid sequence of SEQ ID NO:915; and (ii) a VL comprising a VL CDR1 having an amino acid sequence of SEQ ID NO:916, a VL CDR2 having an amino acid sequence of SEQ ID NO:917, and a VL CDR3 having an amino acid sequence of SEQ ID NO:918. In some embodiments, the second binding domain comprises: (i) a VH comprising a VH CDR1 having an amino acid sequence of SEQ ID NO:919, a VH CDR2 having an amino acid sequence of SEQ ID NO:920, and a VH CDR3 having an amino acid sequence of SEQ ID NO:921; and (ii) a VL comprising a VL CDR1 having an amino acid sequence of SEQ ID NO:922, a VL CDR2 having an amino acid sequence of SEQ ID NO:923, and a VL CDR3 having an amino acid sequence of SEQ ID NO:924. In some embodiments, the second binding domain comprises: (i) a VH comprising a VH CDR1 having an amino acid sequence of SEQ ID NO:925, a VH CDR2 having an amino acid sequence of SEQ ID NO:926, and a VH CDR3 having an amino acid sequence of SEQ ID NO:927; and (ii) a VL comprising a VL CDR1 having an amino acid sequence of SEQ ID NO:928, a VL CDR2 having an amino acid sequence of SEQ ID NO:929, and a VL CDR3 having an amino acid sequence of SEQ ID NO:930. In some embodiments, the second binding domain comprises a VH comprising a VH CDR1, a VH CDR2, and a VH CDR3 having an amino acid sequence of a VH CDR1, VH CDR2, and VH CDR3, respectively, of SEQ ID NO:899. In some embodiments, the second binding domain comprises a VL comprising a VL CDR1, a VL CDR2, and a VL CDR3 having an amino acid sequence of a VL CDR1, VL CDR2, and VL CDR3, respectively, of SEQ ID NO:900. In some embodiments, the second binding domain comprises:

(i) a VH comprising a VH CDR1, a VH CDR2, and a VH CDR3 having an amino acid sequence of a VH CDR1, VH CDR2, and VH CDR3, respectively, of SEQ ID NO:899; and (ii) a VL comprising a VL CDR1, a VL CDR2, and a VL CDR3 having an amino acid sequence of a VL CDR1, VL CDR2, and VL CDR3, respectively, of SEQ ID NO:900. In some embodiments, the second binding domain comprises a VH having an amino acid sequence of SEQ ID NO:899. In some embodiments, the second binding domain comprises a VL having an amino acid sequence of SEQ ID NO:900. In some embodiments, the second binding domain comprises a VH having an amino acid sequence of SEQ ID NO:899, and a VL having an amino acid sequence of SEQ ID NO:900. In some embodiments, the second binding domain comprises a VH having an amino acid sequence having at least 95% identity to an amino acid sequence of SEQ ID NO:899. In some embodiments, the second binding domain comprises a VL having an amino acid sequence having at least 95% identity to an amino acid sequence of SEQ ID NO:900. In some embodiments, the second binding domain comprises a VH having an amino acid sequence having at least 95% identity to an amino acid sequence of SEQ ID NO:899, and a VL having an amino acid sequence having at least 95% identity to an amino acid sequence of SEQ ID NO:900. In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system.

In some embodiments, the second target is KLK2. Thus, in another aspect, provided herein is a multispecific antibody comprising: (a) a first binding domain that binds to Vβ17, and (b) a second binding domain that binds to KLK2. In some embodiments, the multispecific antibody is a bispecific antibody. In some embodiments, the first binding domain comprises the VH CDR1, VH CDR, and VH CDR3 amino acid sequences of a Vβ17 antibody provided herein. In some embodiments, the first binding domain comprises the VL CDR1, VL CDR2 and VL CDR3 amino acid sequences of a Vβ17 antibody provided herein. In some embodiments, the first binding domain comprises the VH CDR1, VH CDR2, VH CDR3, VL CDR1, VL CDR2 and VL CDR3 amino acid sequences of a Vβ17 antibody provided herein. In other embodiments, the first binding domain that binds to Vβ17 comprises a VH amino acid sequence of a Vβ17 antibody provided herein. In other embodiments, the first binding domain that binds to Vβ17 comprises a VL amino acid sequence of a Vβ17 antibody provided herein. In other embodiments, the first binding domain that binds to Vβ17 comprises VH and VL amino acid sequences of a Vβ17 antibody provided herein. In some embodiments, the second binding domain that binds to KLK2 comprises VH CDR1, VH CDR2, VH CDR3, VL CDR1, VL CDR2 and VL CDR3 amino acid sequences of a KLK2 antibody provided herein. In other embodiments, the second binding domain that binds to KLK2 comprises a VH amino acid sequence of a KLK2 antibody provided herein. In other embodiments, the second binding domain that binds to KLK2 comprises a VL amino acid sequence of a KLK2 antibody provided herein. In other embodiments, the second binding domain comprises VH and VL amino acid sequences of a KLK2 antibody provided herein. In some embodiments, the second binding domain that binds to KLK2 comprises: (i) a VH comprising a VH CDR1, a VH CDR2, and a VH CDR3 having an amino acid sequence of a VH CDR1, VH CDR2, and VH CDR3, respectively, of SEQ ID NO:887; and (ii) a VL comprising a VL CDR1, a VL CDR2, and a VL CDR3 having an amino acid sequence of a VL CDR1, VL CDR2, and VL CDR3, respectively, of SEQ ID NO:888. In some embodiments, the second binding domain comprises a VH having an amino acid sequence of SEQ ID NO:887. In some embodiments, the second binding domain comprises a VL having an amino acid sequence of SEQ ID NO:888. In some embodiments, the second binding domain comprises a VH having an amino acid sequence of SEQ ID NO:887, and a VL having an amino acid sequence of SEQ ID NO:888. In some embodiments, the second binding domain comprises a VH having an amino acid sequence having at least 95% identity to an amino acid sequence of SEQ ID NO:887. In some embodiments, the second binding domain comprises a VL having an amino acid sequence having at least 95% identity to an amino acid sequence of SEQ ID NO:888. In some embodiments, the second binding domain comprises a VH having an amino acid sequence having at least 95% identity to an amino acid sequence of SEQ ID NO:887, and a VL having an amino acid sequence having at least 95% identity to an amino acid sequence of SEQ ID NO:888. In some embodiments, the second binding domain comprises a heavy chain having an amino acid sequence of SEQ ID NO:891. In some embodiments, the second binding domain comprises a heavy chain having an amino acid sequence of SEQ ID NO:893. In some embodiments, the second binding domain comprises a heavy chain having an amino acid sequence of SEQ ID NO:894. In some embodiments, the second binding domain comprises a light chain having an amino acid sequence of SEQ ID NO:892. In some embodiments, the second binding domain comprises a heavy chain having an amino acid sequence of SEQ ID NO:891, and a light chain having the amino acid sequence of SEQ ID NO:892. In some embodiments, the second binding domain comprises a heavy chain having an amino acid sequence of SEQ ID NO:893, and a light chain having the amino acid sequence of SEQ ID NO:892. In some embodiments, the second binding domain comprises a heavy chain having an amino acid sequence of SEQ ID NO:894, and a light chain having the amino acid sequence of SEQ ID NO:892. In some embodiments, the second binding domain comprises a heavy chain having an amino acid sequence having at least 95% identity to an amino acid sequence of SEQ ID NO:891. In some embodiments, the second binding domain comprises a heavy chain having an amino acid sequence having at least 95% identity to an amino acid sequence of SEQ ID NO:893. In some embodiments, the second binding domain comprises a heavy chain having an amino acid sequence having at least 95% identity to an amino acid sequence of SEQ ID NO:894. In some embodiments, the second binding domain comprises a light chain having an amino acid sequence having at least 95% identity to an amino acid sequence of SEQ ID NO:892. In some embodiments, the second binding domain comprises a heavy chain having an amino acid sequence having at least 95% identity to an amino acid sequence of SEQ ID NO:891, and a light chain having an amino acid sequence having at least 95% identity to an amino acid sequence of SEQ ID NO:892. In some embodiments, the second binding domain comprises a heavy chain having an amino acid sequence having at least 95% identity to an amino acid sequence of SEQ ID NO:893, and a light chain having an amino acid sequence having at least 95% identity to an amino acid sequence of SEQ ID NO:892. In some embodiments, the second binding domain comprises a heavy chain having an amino acid sequence having at least 95% identity to an amino acid sequence of SEQ ID NO:894, and a light chain having an amino acid sequence having at least 95% identity to an amino acid sequence of SEQ ID NO:892. In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system.

In some embodiments, a multispecific Vβ17 antibody provided herein comprises a heavy chain having an amino acid sequence of SEQ ID NO:1213. In some embodiments, a multispecific Vβ17 antibody provided herein comprises a heavy chain having an amino acid sequence of SEQ ID NO:1171. In some embodiments, a multispecific Vβ17 antibody provided herein comprises a light chain having an amino acid sequence of SEQ ID NO:1199.

In some embodiments, a multispecific Vβ17 antibody provided herein comprises a heavy chain having an amino acid sequence of SEQ ID NO:1130. In some embodiments, a multispecific Vβ17 antibody provided herein comprises a heavy chain having an amino acid sequence of SEQ ID NO:1172. In some embodiments, a multispecific Vβ17 antibody provided herein comprises a light chain having an amino acid sequence of SEQ ID NO:1200.

In some embodiments, a multispecific Vβ17 antibody provided herein comprises a heavy chain having an amino acid sequence of SEQ ID NO:1131. In some embodiments, a multispecific Vβ17 antibody provided herein comprises a heavy chain having an amino acid sequence of SEQ ID NO:1173. In some embodiments, a multispecific Vβ17 antibody provided herein comprises a light chain having an amino acid sequence of SEQ ID NO:1201.

In some embodiments, a multispecific Vβ17 antibody provided herein comprises a heavy chain having an amino acid sequence of SEQ ID NO:1132. In some embodiments, a multispecific Vβ17 antibody provided herein comprises a heavy chain having an amino acid sequence of SEQ ID NO:1174. In some embodiments, a multispecific Vβ17 antibody provided herein comprises a light chain having an amino acid sequence of SEQ ID NO:1202.

In some embodiments, a multispecific Vβ17 antibody provided herein comprises a heavy chain having an amino acid sequence of SEQ ID NO:1133. In some embodiments, a multispecific Vβ17 antibody provided herein comprises a heavy chain having an amino acid sequence of SEQ ID NO:1175. In some embodiments, a multispecific Vβ17 antibody provided herein comprises a light chain having an amino acid sequence of SEQ ID NO:1203.

In some embodiments, a multispecific Vβ17 antibody provided herein comprises a heavy chain having an amino acid sequence of SEQ ID NO:1134. In some embodiments, a multispecific Vβ17 antibody provided herein comprises a heavy chain having an amino acid sequence of SEQ ID NO:1176. In some embodiments, a multispecific Vβ17 antibody provided herein comprises a light chain having an amino acid sequence of SEQ ID NO:1204.

In some embodiments, a multispecific Vβ17 antibody provided herein comprises a heavy chain having an amino acid sequence of SEQ ID NO:1135. In some embodiments, a multispecific Vβ17 antibody provided herein comprises a heavy chain having an amino acid sequence of SEQ ID NO:1177. In some embodiments, a multispecific Vβ17 antibody provided herein comprises a light chain having an amino acid sequence of SEQ ID NO:1205.

In some embodiments, a multispecific Vβ17 antibody provided herein comprises a heavy chain having an amino acid sequence of SEQ ID NO:1136. In some embodiments, a multispecific Vβ17 antibody provided herein comprises a heavy chain having an amino acid sequence of SEQ ID NO:1178. In some embodiments, a multispecific Vβ17 antibody provided herein comprises a light chain having an amino acid sequence of SEQ ID NO:1206.

In some embodiments, a multispecific Vβ17 antibody provided herein comprises a heavy chain having an amino acid sequence of SEQ ID NO:1137. In some embodiments, a multispecific Vβ17 antibody provided herein comprises a heavy chain having an amino acid sequence of SEQ ID NO:1179. In some embodiments, a multispecific Vβ17 antibody provided herein comprises a light chain having an amino acid sequence of SEQ ID NO:1207.

In some embodiments, a multispecific Vβ17 antibody provided herein comprises a heavy chain having an amino acid sequence of SEQ ID NO:1138. In some embodiments, a multispecific Vβ17 antibody provided herein comprises a heavy chain having an amino acid sequence of SEQ ID NO:1180. In some embodiments, a multispecific Vβ17 antibody provided herein comprises a light chain having an amino acid sequence of SEQ ID NO:1208.

In some embodiments, a multispecific Vβ17 antibody provided herein comprises a heavy chain having an amino acid sequence of SEQ ID NO:1139. In some embodiments, a multispecific Vβ17 antibody provided herein comprises a heavy chain having an amino acid sequence of SEQ ID NO:1181. In some embodiments, a multispecific Vβ17 antibody provided herein comprises a light chain having an amino acid sequence of SEQ ID NO:1209.

In some embodiments, a multispecific Vβ17 antibody provided herein comprises a heavy chain having an amino acid sequence of SEQ ID NO:1140. In some embodiments, a multispecific Vβ17 antibody provided herein comprises a heavy chain having an amino acid sequence of SEQ ID NO:1182. In some embodiments, a multispecific Vβ17 antibody provided herein comprises a light chain having an amino acid sequence of SEQ ID NO:1210.

In some embodiments, a multispecific Vβ17 antibody provided herein comprises a heavy chain having an amino acid sequence of SEQ ID NO:1141. In some embodiments, a multispecific Vβ17 antibody provided herein comprises a heavy chain having an amino acid sequence of SEQ ID NO:1183. In some embodiments, a multispecific Vβ17 antibody provided herein comprises a light chain having an amino acid sequence of SEQ ID NO:1211.

In some embodiments, a multispecific Vβ17 antibody provided herein comprises a heavy chain having an amino acid sequence of SEQ ID NO:1142. In some embodiments, a multispecific Vβ17 antibody provided herein comprises a heavy chain having an amino acid sequence of SEQ ID NO:1184. In some embodiments, a multispecific Vβ17 antibody provided herein comprises a light chain having an amino acid sequence of SEQ ID NO:1212.

In some embodiments, a multispecific Vβ17 antibody provided herein comprises a heavy chain having an amino acid sequence of SEQ ID NO:1143. In some embodiments, a multispecific Vβ17 antibody provided herein comprises a light chain having an amino acid sequence of SEQ ID NO:1157. In some embodiments, a multispecific Vβ17 antibody provided herein comprises a heavy chain having an amino acid sequence of SEQ ID NO:1185.

In some embodiments, a multispecific Vβ17 antibody provided herein comprises a heavy chain having an amino acid sequence of SEQ ID NO:1144. In some embodiments, a multispecific Vβ17 antibody provided herein comprises a light chain having an amino acid sequence of SEQ ID NO:1158. In some embodiments, a multispecific Vβ17 antibody provided herein comprises a heavy chain having an amino acid sequence of SEQ ID NO:1186.

In some embodiments, a multispecific Vβ17 antibody provided herein comprises a heavy chain having an amino acid sequence of SEQ ID NO:1145. In some embodiments, a multispecific Vβ17 antibody provided herein comprises a light chain having an amino acid sequence of SEQ ID NO:1159. In some embodiments, a multispecific Vβ17 antibody provided herein comprises a heavy chain having an amino acid sequence of SEQ ID NO:1187.

In some embodiments, a multispecific Vβ17 antibody provided herein comprises a heavy chain having an amino acid sequence of SEQ ID NO:1146. In some embodiments, a multispecific Vβ17 antibody provided herein comprises a light chain having an amino acid sequence of SEQ ID NO:1160. In some embodiments, a multispecific Vβ17 antibody provided herein comprises a heavy chain having an amino acid sequence of SEQ ID NO:1188.

In some embodiments, a multispecific Vβ17 antibody provided herein comprises a heavy chain having an amino acid sequence of SEQ ID NO:1147. In some embodiments, a multispecific Vβ17 antibody provided herein comprises a light chain having an amino acid sequence of SEQ ID NO:1161. In some embodiments, a multispecific Vβ17 antibody provided herein comprises a heavy chain having an amino acid sequence of SEQ ID NO:1189.

In some embodiments, a multispecific Vβ17 antibody provided herein comprises a heavy chain having an amino acid sequence of SEQ ID NO:1148. In some embodiments, a multispecific Vβ17 antibody provided herein comprises a light chain having an amino acid sequence of SEQ ID NO:1162. In some embodiments, a multispecific Vβ17 antibody provided herein comprises a heavy chain having an amino acid sequence of SEQ ID NO:1190.

In some embodiments, a multispecific Vβ17 antibody provided herein comprises a heavy chain having an amino acid sequence of SEQ ID NO:1149. In some embodiments, a multispecific Vβ17 antibody provided herein comprises a light chain having an amino acid sequence of SEQ ID NO:1163. In some embodiments, a multispecific Vβ17 antibody provided herein comprises a heavy chain having an amino acid sequence of SEQ ID NO:1191.

In some embodiments, a multispecific Vβ17 antibody provided herein comprises a heavy chain having an amino acid sequence of SEQ ID NO:1150. In some embodiments, a multispecific Vβ17 antibody provided herein comprises a light chain having an amino acid sequence of SEQ ID NO:1164. In some embodiments, a multispecific Vβ17 antibody provided herein comprises a heavy chain having an amino acid sequence of SEQ ID NO:1192.

In some embodiments, a multispecific Vβ17 antibody provided herein comprises a heavy chain having an amino acid sequence of SEQ ID NO:1151. In some embodiments, a multispecific Vβ17 antibody provided herein comprises a light chain having an amino acid sequence of SEQ ID NO:1165. In some embodiments, a multispecific Vβ17 antibody provided herein comprises a heavy chain having an amino acid sequence of SEQ ID NO:1193.

In some embodiments, a multispecific Vβ17 antibody provided herein comprises a heavy chain having an amino acid sequence of SEQ ID NO:1152. In some embodiments, a multispecific Vβ17 antibody provided herein comprises a light chain having an amino acid sequence of SEQ ID NO:1166. In some embodiments, a multispecific Vβ17 antibody provided herein comprises a heavy chain having an amino acid sequence of SEQ ID NO:1194.

In some embodiments, a multispecific Vβ17 antibody provided herein comprises a heavy chain having an amino acid sequence of SEQ ID NO:1153. In some embodiments, a multispecific Vβ17 antibody provided herein comprises a light chain having an amino acid sequence of SEQ ID NO:1167. In some embodiments, a multispecific Vβ17 antibody provided herein comprises a heavy chain having an amino acid sequence of SEQ ID NO:1195.

In some embodiments, a multispecific Vβ17 antibody provided herein comprises a heavy chain having an amino acid sequence of SEQ ID NO:1154. In some embodiments, a multispecific Vβ17 antibody provided herein comprises a light chain having an amino acid sequence of SEQ ID NO:1168. In some embodiments, a multispecific Vβ17 antibody provided herein comprises a heavy chain having an amino acid sequence of SEQ ID NO:1196.

In some embodiments, a multispecific Vβ17 antibody provided herein comprises a heavy chain having an amino acid sequence of SEQ ID NO:1155. In some embodiments, a multispecific Vβ17 antibody provided herein comprises a light chain having an amino acid sequence of SEQ ID NO:1169. In some embodiments, a multispecific Vβ17 antibody provided herein comprises a heavy chain having an amino acid sequence of SEQ ID NO:1197.

In some embodiments, a multispecific Vβ17 antibody provided herein comprises a heavy chain having an amino acid sequence of SEQ ID NO:1156. In some embodiments, a multispecific Vβ17 antibody provided herein comprises a light chain having an amino acid sequence of SEQ ID NO:1170. In some embodiments, a multispecific Vβ17 antibody provided herein comprises a heavy chain having an amino acid sequence of SEQ ID NO:1198.

In some embodiments, a multispecific Vβ17 antibody provided herein comprises a heavy chain having at least 95% identity to the amino acid sequence of a heavy chain provided herein. In some embodiments, a multispecific Vβ17 antibody provided herein comprises a light chain having at least 95% identity to the amino acid sequence of a light chain provided herein.

According to a particular aspect, the invention relates to an isolated Vβ17 bispecific antibody or antigen-binding fragment thereof comprising (a) a first heavy chain (HC1); (b) a second heavy chain (HC2); (c) a first light chain (LC1); and (d) a second light chain (LC2). The HC1 can be associated with the LC1 and the HC2 can be associated with LC2. The HC1 can comprise a heavy chain complementarity determining region 1 (HCDR1), HCDR2, and HCDR3 comprising the amino acid sequences of SEQ ID NO:1, SEQ ID NO:2, and SEQ ID NO:3, respectively, and LC1 can comprise a light chain complementarity determining region 1 (LCDR1), LCDR2, and LCDR3 comprising the amino acid sequences of SEQ ID NO:4, SEQ ID NO:5, and SEQ ID NO:6, respectively.

The HC1 and LC1 form a binding site for a first antigen, and the HC2 and LC2 form a binding site for a second antigen. By way of an example, the binding site for the first antigen can bind to a Vβ17 on a CD8+ or CD4+ T cell, and the binding site for the second antigen can, for example, bind a tumor antigen present on the surface of a cancer cell. The binding of the Vβ17 bispecific antibody to Vβ17 present on the surface of the CD8+ or CD4+ T cell, and the binding of the tumor antigen present on the surface of the cancer cells can, for example, result in the killing of the cancer cell.

Also provided herein are bispecific antibodies capable of binding Vβ17, an antigen associated with T cells, and CD123, an antigen associated with cancer cells. Cytotoxic T cells express T cell receptors that consist of α- and β-chains, such as Vβ17. It is hypothesized that a bispecific antibody binding to Vβ17 and a cancer-associated antigen, such as CD123, may direct a cytotoxic T cell to an antigen-expressing cancer cell. Utilizing a bispecific antibody of this sort to recruit, or redirect, the cytotoxic T cell to an antigen-expressing cancer cell and could allow the T cell to kill the cancer cell.

In one general aspect, the present disclosure relates to isolated bispecific antibodies or antigen-binding fragments thereof that bind to Vβ17 and CD123.

Provided herein are isolated Vβ17 bispecific antibodies or antigen-binding fragments thereof. The isolated Vβ17 bispecific antibody or antigen-binding fragment thereof comprises:
 a. a first heavy chain (HC1);
 b. a second heavy chain (HC2);
 c. a first light chain (LC1); and
 d. a second light chain (LC2),
wherein HC1 is associated with LC1 and HC2 is associated with LC2, and wherein HC1 comprises a heavy chain complementarity determining region 1 (HCDR1), HCDR2, and HCDR3 comprising the amino acid sequences of SEQ ID NO:1, SEQ ID NO:2, and SEQ ID NO:3, respectively, and LC1 comprises a light chain complementarity determining region 1 (LCDR1), LCDR2, and LCDR3 comprising the amino acid sequences of SEQ ID NO:4, SEQ ID NO:5, and SEQ ID NO:6, respectively, to form a binding site for a first antigen, and wherein HC2 and LC2 form a binding site for a second antigen. In certain embodiments, the binding site for the first antigen binds to a Vβ17 on the surface of a CD8+ or CD4+ T cell. In certain embodiments, the binding site for the second antigen binds to a tumor antigen present on the surface of a cancer cell.

In certain embodiments, the binding of the bispecific antibody to Vβ17 present on the surface of the CD8+ or CD4+ T cell and the binding of the tumor antigen present on the surface of the cancer cells results in the killing of the cancer cell.

In certain embodiments, HC2 and LC2 bind to CD123.

In certain embodiments, the bispecific antibody or antigen-binding fragment thereof is an IgG isotype, such as IgG4.

In certain embodiments, the bispecific antibody or antigen-binding fragment thereof induces CD8+ or CD4+ T-cell dependent cytotoxicity of a cancer cell in vitro with an $EC_{50}$ of less than about 0.2 pM.

Also provided are isolated anti-Vβ17/anti-CD123 bispecific antibodies or antigen-binding fragments thereof. The anti-Vβ17/anti-CD123 bispecific antibodies or antigen-binding fragments thereof comprise:
 a. first heavy chain (HC1);
 b. second heavy chain (HC2)
 c. a first light chain (LC1); and
 d. a second light chain (LC2),
wherein HC1 is associated with LC1 and HC2 is associated with LC2, and wherein HC1 comprises a heavy chain complementarity determining region 1 (HCDR1), HCDR2, and HCDR3 comprising the amino acid sequences of SEQ ID NO:1, SEQ ID NO:2, and SEQ ID NO:3, respectively, and LC1 comprises a light chain complementarity determining region 1 (LCDR1), LCDR2, and LCDR3 comprising the amino acid sequences of SEQ ID NO:4, SEQ ID NO:5, and SEQ ID NO:6, respectively, to form a binding site for a first antigen that specifically binds Vβ17, and wherein HC2 comprises a heavy chain complementarity determining region 1 (HCDR1), HCDR2, and HCDR3 comprising the amino acid sequences of SEQ ID NO:34, SEQ ID NO:35, and SEQ ID NO:36, respectively, and LC2 comprises a light chain complementarity determining region 1 (LCDR1), LCDR2, and LCDR3 comprising the amino acid sequences of SEQ ID NO:37, SEQ ID NO:38, and SEQ ID NO:39, respectively, to form a biding site for a second antigen that specifically binds CD123. In certain embodiments, the HC1 comprises the amino acid sequence of SEQ ID NO:13 and LC1 comprises the amino acid sequence of SEQ ID NO:14, and the HC2 comprises the amino acid sequence of SEQ ID NO:15 and LC2 comprises the amino acid sequence of SEQ ID NO:16. In certain embodiments, the Vβ17 is on the surface of a CD8+ or CD4+ T cell. In certain embodiments, the CD123 is on the surface of a cancer cell. In certain embodiments, the bispecific antibody or antigen-binding fragment thereof induces CD8+ or CD4+ T-cell dependent cytotoxicity of a cancer cell in vitro with an $EC_{50}$ of less than about 0.2 pM.

In certain embodiments, the anti-Vβ17/anti-CD123 bispecific antibodies or antigen-binding fragments thereof are chimeric, partially humanized, or fully humanized.

Also provided are isolated humanized Vβ17 monoclonal antibodies or antigen-binding fragments thereof. The isolated humanized Vβ17 monoclonal antibody or antigen-binding fragment thereof can comprise an amino acid sequence with at least 95% identity to the amino acid sequence of SEQ ID NO:28. In certain embodiments, the isolated humanized Vβ17 monoclonal antibody or antigen-binding fragment thereof comprises an amino acid sequence of SEQ ID NO:28.

Also provided herein are anti-Vβ17/anti-CD123 bispecific antibodies or antigen-binding fragments thereof comprising an anti-Vβ17 antibody or an antigen-binding fragment thereof and an anti-CD123 antibody or antigen-binding fragment thereof. In certain embodiments the anti-Vβ17/anti-CD123 bispecific antibody or antigen-binding fragment thereof comprises (a) a first heavy chain (HC1); (b) a second heavy chain (HC2); (c) a first light chain (LC1); and a second light chain (LC2). The HC1 is associated with the LC1 and the HC2 is associated with the LC2. In certain embodiments, the HC1 comprises a heavy chain complementarity determining region 1 (HCDR1), HCDR2, and HCDR3 comprising the amino acid sequences of SEQ ID NO:1, SEQ ID NO:2, and SEQ ID NO:3, respectively, and LC1 comprises a light chain complementarity determining region 1 (LCDR1), LCDR2, and LCDR3 comprising the amino acid sequences of SEQ ID NO:4, SEQ ID NO:5, and SEQ ID NO:6, respectively. In certain embodiments, the HC2 comprises a heavy chain complementarity determining region 1 (HCDR1), HCDR2, and HCDR3 comprising the amino acid sequences of SEQ ID NO:34, SEQ ID NO:35, and SEQ ID NO:36, respectively, and LC2 comprises a light chain complementarity determining region 1 (LCDR1), LCDR2, and LCDR3 comprising the amino acid sequences of SEQ ID NO:37, SEQ ID NO:38, and SEQ ID NO:39, respectively In certain embodiments, the HC1 can, for example, comprise an amino acid sequence of SEQ ID NO:13 and the LC1 can, for example, comprise an amino acid sequence of SEQ ID NO:14 to form a binding site for a first antigen that specifically binds Vβ17. The HC2 can, for example, comprise an amino acid sequence of SEQ ID NO:15 and the LC2 can, for example, comprise an amino acid sequence of SEQ ID NO:16 to form a binding site for a second antigen that specifically binds CD123.

The binding site for a second antigen can, for example, bind a cancer antigen present on the surface of a cancer cell. In some embodiments, the second antigen is CD123. In some embodiments, the second antigen is BCMA. In some embodiments, the second antigen is DLL3. In some embodiments, the second antigen is PSMA. In some embodiments, the second antigen is KLK2. The binding of the Vβ17 bispecific antibody to Vβ17 present on the surface of the T cell, and the binding of the second antigen present on the surface of the target cell can, for example, result in the killing of the target cell. The binding of the Vβ17 bispecific antibody to Vβ17 present on the surface of the T cell, and the binding of the cancer or tumor associated antigen present on the surface of the cancer cell can, for example, result in the killing of the cancer cell.

In certain embodiments, the first binding domain of the bispecific antibody specifically binds Vβ17. In some embodiments, the Vβ17 is present on the surface of a T cell. In some embodiments, the antibody is a humanized antibody. In certain embodiments, the antibody is an IgG antibody. In other embodiments, the IgG antibody is an IgG1, IgG2, IgG3, or IgG4 antibody.

In certain embodiments, the anti-Vβ17 antibodies or antigen binding fragments thereof binds to a first epitope located on Vβ17 and a second epitope of a second target antigen.

In some embodiments, provided herein is a bispecific antibody comprising: (a) a first binding domain that binds to a Vβ17 antigen, and (b) a second binding domain that binds to a second target antigen. In some embodiments, provided herein is a bispecific antibody comprising: (a) a first binding domain that specifically binds to a Vβ17 antigen, and (b) a second binding domain that specifically binds to a second target antigen.

In some embodiments, provided herein is a bispecific antibody comprising: (a) a first binding domain that binds to a first epitope on a Vβ17 antigen, and (b) a second binding domain that binds to a second epitope on a second target antigen. In some embodiments, provided herein is a bispecific antibody comprising: (a) a first binding domain that specifically binds to a first epitope on a Vβ17 antigen, and (b) a second binding domain that specifically binds to a second epitope on a second target antigen.

In specific embodiments, the Vβ17 antigen is on the surface of a T cell. In certain embodiments, the second target antigen is not Vβ17. The binding of the Vβ17 bispecific antibody to Vβ17 present on the surface of the T cell, and the binding of the second target antigen present on the surface of the second target cell can, for example, result in the killing of the second target cell.

In certain embodiments, the bispecific antibody comprises a second binding domain that binds to tumor associated antigen.

In certain embodiments, the anti-Vβ17 antibodies or antigen binding fragments thereof binds to a first epitope located on Vβ17 and a second epitope of a cancer cell.

In some embodiments, provided herein is a bispecific antibody comprising: (a) a first binding domain that binds to a Vβ17 antigen, and (b) a second binding domain that binds to a cancer cell antigen. In some embodiments, provided herein is a bispecific antibody comprising: (a) a first binding domain that specifically binds to a Vβ17 antigen, and (b) a second binding domain that specifically binds to a cancer cell antigen. In some embodiments, the antigen is CD123. In some embodiments, the antigen is BCMA. In some embodiments, the antigen is DLL3. In some embodiments, the antigen is PSMA. In some embodiments, the antigen is KLK2.

In some embodiments, provided herein is a bispecific antibody comprising: (a) a first binding domain that binds to a first epitope on a Vβ17 antigen, and (b) a second binding domain that binds to a second epitope on a cancer cell antigen. In some embodiments, provided herein is a bispecific antibody comprising: (a) a first binding domain that specifically binds to a first epitope on a Vβ17 antigen, and (b) a second binding domain that specifically binds to a second epitope on a cancer cell antigen. In some embodiments, the antigen is CD123. In some embodiments, the antigen is BCMA. In some embodiments, the antigen is DLL3. In some embodiments, the antigen is PSMA. In some embodiments, the antigen is KLK2.

In an embodiment of the bispecific antibodies provided herein, the first epitope is located on Vβ17 and the second epitope is located on the surface of a cancer cell. In some embodiments, the second epitope is located on a cancer cell antigen. In an embodiment of the bispecific antibodies provided herein, the first epitope is located on Vβ17 and the second epitope is located on a tumor. In an embodiment of the bispecific antibodies provided herein, the first epitope is located on Vβ17 and the second epitope is located on a tumor-specific antigen. In an embodiment of the bispecific antibodies provided herein, the first epitope is located on Vβ17 and the second epitope is located on a tumor associated antigen. In an embodiment of the bispecific antibodies provided herein, the first epitope is located on Vβ17 and the second epitope is located on a neoantigen.

In some embodiments, the cancer cell is a cell of an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer. In some embodiments, the cancer is an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer. In some embodiments, the cancer is a adrenal cancer. In some embodiments, the cancer is a anal cancer. In some embodiments, the cancer is an appendix cancer. In some embodiments, the cancer is a bile duct cancer. In some embodiments, the cancer is a bladder cancer. In some embodiments, the cancer is a bone cancer. In some embodiments, the cancer is a brain cancer. In some embodiments, the cancer is a breast cancer. In some embodiments, the cancer is a cervical cancer. In some embodiments, the cancer is a colorectal cancer. In some embodiments, the cancer is a esophageal cancer. In some embodiments, the cancer is a gallbladder cancer. In some embodiments, the cancer is a gestational trophoblastic. In some embodiments, the cancer is a head and neck cancer. In some embodiments, the cancer is a Hodgkin lymphoma. In some embodiments, the cancer is an intestinal cancer. In some embodiments, the cancer is a kidney cancer. In some embodiments, the cancer is a leukemia. In some embodiments, the cancer is a liver cancer. In some embodiments, the cancer is a lung cancer. In some embodiments, the cancer is a melanoma. In some embodiments, the cancer is a mesothelioma. In some embodiments, the cancer is a multiple myeloma. In some embodiments, the cancer is a neuroendocrine tumor. In some embodiments, the cancer is a non-Hodgkin lymphoma. In some embodiments, the cancer is an oral cancer. In some embodiments, the cancer is a ovarian cancer. In some embodiments, the cancer is a pancreatic cancer. In some embodiments, the cancer is a prostate cancer. In some embodiments, the cancer is a sinus cancer. In some embodiments, the cancer is a skin cancer. In some embodiments, the cancer is a soft tissue sarcoma spinal cancer. In some embodiments, the cancer is a stomach cancer. In some embodiments, the cancer is a testicular cancer. In some embodiments, the cancer is a throat cancer. In some embodiments, the cancer is a thyroid cancer. In some embodiments, the cancer is a uterine cancer endometrial cancer. In some embodiments, the cancer is a vaginal cancer. In some embodiments, the cancer is a vulvar cancer.

In some embodiments, the adrenal cancer is an adrenocortical carcinoma (ACC), adrenal cortex cancer, pheochromocytoma, or neuroblastoma. In some embodiments, the anal cancer is a squamous cell carcinoma, cloacogenic carcinoma, adenocarcinoma, basal cell carcinoma, or melanoma. In some embodiments, the appendix cancer is a neuroendocrine tumor (NET), mucinous adenocarcinoma, goblet cell carcinoid, intestinal-type adenocarcinoma, or signet-ring cell adenocarcinoma. In some embodiments, the bile duct cancer is an extrahepatic bile duct cancer, adenocarcinomas, hilar bile duct cancer, perihilar bile duct cancer, distal bile duct cancer, or intrahepatic bile duct cancer. In some embodiments, the bladder cancer is transitional cell carcinoma (TCC), papillary carcinoma, flat carcinoma, squamous cell carcinoma, adenocarcinoma, small-cell carcinoma, or sarcoma. In some embodiments, the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer. In some embodiments, the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma. In some embodiments, the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer. In some embodiments, the cervical cancer is a squamous cell carcinoma, or adenocarcinoma. In some embodiments, the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma. In some embodiments, the esophageal cancer is an adenocarcinoma or squamous cell carcinoma. In some embodiments, the gall bladder cancer is an adenocarcinoma, papillary adenocarcinoma, adenosquamous carcinoma, squamous cell carcinoma, small cell carcinoma, or sarcoma. In some embodiments, the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT). In some embodiments, the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer. In some embodiments, the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL). In some embodiments, the intestinal cancer is a small intestine cancer, small bowel cancer, adenocarcinoma, sarcoma, gastrointestinal stromal tumors, carcinoid tumors, or lymphoma. In some embodiments, the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma. In some embodiments, the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS). In a specific embodiment, the leukemia is AML. In some embodiments, the liver cancer is a hepatocellular carcinoma (HCC), fibrolamellar HCC, cholangiocarcinoma, angiosarcoma, or liver metastasis. In some embodiments, the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor. In some embodiments, the melanoma is a superficial spreading melanoma, nodular melanoma, acral-lentiginous melanoma, lentigo maligna melanoma, amelanotic melanoma, desmoplastic melanoma, ocular melanoma, or metastatic melanoma. In some embodiments, the mesothelioma is a pleural mesothelioma, peritoneal mesothelioma, pericardial mesothelioma, or testicular mesothelioma. In some embodiments, the multiple myeloma is an active myeloma or smoldering myeloma. In some embodiments, the neuroendocrine tumor, is a gastrointestinal neuroendocrine tumor, pancreatic neuroendocrine tumor, or lung neuroendocrine tumor. In some embodiments, the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma. In some embodiments, the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma acuminatum, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer. In some embodiments, the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst. In some embodiments, the pancreatic cancer is a pancreatic exocrine gland cancer, pancreatic endocrine gland cancer, or pancreatic adenocarcinoma, islet cell tumor, or neuroendocrine tumor. In some embodiments, the prostate cancer is a prostate adenocarcinoma, prostate sarcoma, transitional cell carcinoma, small cell carcinoma, or neuroendocrine tumor. In some embodiments, the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer. In some embodiments, the skin cancer is a basal cell carcinoma, squamous cell carcinoma, melanoma, Merkel cell carcinoma, Kaposi sarcoma (KS), actinic keratosis, skin lymphoma, or keratoacanthoma. In some embodiments, the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma. In some embodiments, the spinal cancer is a spinal metastatic tumor. In some embodiments, the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid. In some embodiments, the testicular cancer is a seminoma, non-seminoma, embryonal carcinoma, yolk sac carcinoma, choriocarcinoma, teratoma, gonadal stromal tumor, leydig cell tumor, or sertoli cell tumor. In some embodiments, the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer. In some embodiments, the thyroid cancer is a papillary carcinoma, follicular carcinoma, Hürthle cell carcinoma, medullary thyroid carcinoma, or anaplastic carcinoma. In some embodiments, the uterine cancer is an endometrial cancer, endometrial adenocarcinoma, endometroid carcinoma, serous adenocarcinoma, adenosquamous carcinoma, uterine carcinosarcoma, uterine sarcoma, uterine leiomyosarcoma, endometrial stromal sarcoma, or undifferentiated sarcoma. In some embodiments, the vaginal cancer is a squamous cell carcinoma, adenocarcinoma, melanoma, or sarcoma. In some embodiments, the vulvar cancer is a squamous cell carcinoma or adenocarcinoma.

In some embodiments, the second epitope is located on a cancer antigen.

In some embodiments, the cancer antigen is angiopoietin, BCMA, CD19, CD20, CD22, CD25 (IL2-R), CD30, CD33, CD37, CD38, CD52, CD56, CD123 (IL-3R), cMET, DLL/Notch, EGFR, EpCAM, FGF, FGF-R, GD2, HER2, Mesothelin, Nectin-4, PDGFRα, RANKL, SLAMF7, TROP2, VEGF, or VEGF-R. In some embodiments, the cancer antigen is angiopoietin. In some embodiments, the cancer antigen is BCMA. In some embodiments, the cancer antigen is CD19. In some embodiments, the cancer antigen is CD20. In some embodiments, the cancer antigen is CD22. In some embodiments, the cancer antigen is CD25 (IL2-R). In some embodiments, the cancer antigen is CD30. In some embodiments, the cancer antigen is CD33. In some embodiments, the cancer antigen is CD37. In some embodiments, the cancer antigen is CD38. In some embodiments, the cancer antigen is CD52. In some embodiments, the cancer antigen is CD56. In some embodiments, the cancer antigen is CD123 (IL-3R). In some embodiments, the cancer antigen is cMET. In some embodiments, the cancer antigen is DLL/Notch. In some embodiments, the cancer antigen is EGFR. In some embodiments, the cancer antigen is EpCAM. In some embodiments, the cancer antigen is FGF. In some embodiments, the cancer antigen is FGF-R. In some embodiments, the cancer antigen is GD2. In some embodiments, the cancer antigen is HER2. In some embodiments, the cancer antigen is Mesothelin. In some embodiments, the cancer antigen is Nectin-4. In some embodiments, the cancer antigen is PDGFRα. In some embodiments, the cancer antigen is RANKL. In some embodiments, the cancer antigen is SLAMF7. In some embodiments, the cancer antigen is TROP2. In some embodiments, the cancer antigen is VEGF. In some embodiments, the cancer antigen is VEGF-R. In some embodiments, the cancer antigen is PSMA. In some embodiments, the cancer antigen is KLK2.

In some embodiments, the cancer antigen is CEA, immature laminin receptor, TAG-72, HPV E6, HPV E7, BING-4, calcium-activated chloride channel 2, cyclin-B1, 9D7, EpCAM, EphA3, Her2/neu, telomerase, mesothelin, SAP-1, surviving, a BAGE family antigen, CAGE family antigen, GAGE family antigen, MAGE family antigen, SAGE family antigen, XAGE family antigen, NY-ESO-1/LAGE-1, PRAME, SSX-2, Melan-A, MART-1, Gp100, pmel17, tyrosinase, TRP-1, TRP-2, P. polypeptide, MC1R, prostate-specific antigen, β-catenin, BRCA1, BRCA2, CDK4, CML66, fibronectin, MART-2, p53, Ras, TGF-βRII, or MUC1. In some embodiments, the cancer antigen is CEA. In some embodiments, the cancer antigen is immature laminin receptor. In some embodiments, the cancer antigen is TAG-72. In some embodiments, the cancer antigen is HPV E6. In some embodiments, the cancer antigen is HPV E7. In some embodiments, the cancer antigen is BING-4. In some embodiments, the cancer antigen is calcium-activated chloride channel 2. In some embodiments, the cancer antigen is cyclin-B1. In some embodiments, the cancer antigen is 9D7. In some embodiments, the cancer antigen is EpCAM. In some embodiments, the cancer antigen is EphA3. In some embodiments, the cancer antigen is Her2/neu. In some embodiments, the cancer antigen is telomerase. In some embodiments, the cancer antigen is mesothelin. In some embodiments, the cancer antigen is SAP-1. In some embodiments, the cancer antigen is surviving. In some embodiments, the cancer antigen is a BAGE family antigen. In some embodiments, the cancer antigen is CAGE family antigen. In some embodiments, the cancer antigen is GAGE family antigen. In some embodiments, the cancer antigen is MAGE family antigen. In some embodiments, the cancer antigen is SAGE family antigen. In some embodiments, the cancer antigen is XAGE family antigen. In some embodiments, the cancer antigen is NY-ESO-1/LAGE-1. In some embodiments, the cancer antigen is PRAME. In some embodiments, the cancer antigen is SSX-2. In some embodiments, the cancer antigen is Melan-A. In some embodiments, the cancer antigen is MART-1. In some embodiments, the cancer antigen is Gp100. In some embodiments, the cancer antigen is pmel17. In some embodiments, the cancer antigen is tyrosinase. In some embodiments, the cancer antigen is TRP-1. In some embodiments, the cancer antigen is TRP-2. In some embodiments, the cancer antigen is P. polypeptide. In some embodiments, the cancer antigen is MC1R. In some embodiments, the cancer antigen is prostate-specific antigen. In some embodiments, the cancer antigen is β-catenin. In some embodiments, the cancer antigen is BRCA1. In some embodiments, the cancer antigen is BRCA2. In some embodiments, the cancer antigen is CDK4. In some embodiments, the cancer antigen is CML66. In some embodiments, the cancer antigen is fibronectin. In some embodiments, the cancer antigen is MART-2. In some embodiments, the cancer antigen is p53. In some embodiments, the cancer antigen is Ras. In some embodiments, the cancer antigen is TGF-βRII. In some embodiments, the cancer antigen is MUC1.

The binding of the Vβ17 bispecific antibody to Vβ17 present on the surface of the T cell, and the binding of the tumor associated antigen present on the surface of the cancer cell can, for example, result in the killing of the cancer cell.

In an embodiment of the bispecific antibodies provided herein, the first epitope is located on Vβ17 and the second epitope is located on CD123. In an embodiment of the bispecific antibodies provided herein, the first epitope is located on Vβ17 and the second epitope is located on BCMA. In an embodiment of the bispecific antibodies provided herein, the first epitope is located on Vβ17 and the second epitope is located on DLL3. In an embodiment of the bispecific antibodies provided herein, the first epitope is located on Vβ17 and the second epitope is located on PSMA. In an embodiment of the bispecific antibodies provided herein, the first epitope is located on Vβ17 and the second epitope is located on KLK2.

In an embodiment of the bispecific antibodies provided herein, the first epitope is located on Vβ17 and the second epitope is located on PD-1, PD-L1, CTLA-4, EGFR, HER-2, CD19, CD20, CD3 and/or other cancer associated immune suppressors or surface antigens.

In certain embodiments, the anti-Vβ17 antibodies or antigen binding fragments thereof binds to a first epitope located on Vβ17 and a second epitope of a B cell antigen.

In some embodiments, provided herein is a bispecific antibody comprising: (a) a first binding domain that binds to a Vβ17 antigen, and (b) a second binding domain that binds to a B cell antigen. In some embodiments, provided herein is a bispecific antibody comprising: (a) a first binding domain that specifically binds to a Vβ17 antigen, and (b) a second binding domain that specifically binds to a B cell antigen.

In some embodiments, provided herein is a bispecific antibody comprising: (a) a first binding domain that binds to a first epitope on a Vβ17 antigen, and (b) a second binding domain that binds to a second epitope on a B cell antigen. In some embodiments, provided herein is a bispecific antibody comprising: (a) a first binding domain that specifically binds to a first epitope on a Vβ17 antigen, and (b) a second binding domain that specifically binds to a second epitope on a B cell antigen.

In specific embodiments, the Vβ17 antigen is on the surface of a T cell. The binding of the Vβ17 bispecific antibody to Vβ17 present on the surface of the T cell, and the binding of the B cell antigen present on the surface of the B cell can, for example, result in the killing of the target B cell.

In an embodiment of the bispecific antibodies provided herein, the first epitope is located on Vβ17 and the second epitope is located on the surface of a B cell. In some embodiments, the second epitope is located on a B cell antigen.

In some embodiments, the B cell antigen is a CD1a, CD1b, CD1c, CD1d, CD2, CD5, CD6, CD9, CD11a, CD11b, CD11c, CD17, CD18, CD19, CD20, CD21, CD22, CD23, CD24, CD25, CD26, CD27, CD29, CD30, CD31, CD32a, CD32b, CD35, CD37, CD38, CD39, CD40, CD45, CD45RA, CD45RB, CD45RC, CD45RO, CD46, CD47, CD48, CD49b, CD49c, CD49d, CD50, CD52, CD53, CD54, CD55, CD58, CD60a, CD62L, CD63, CD68, CD69, CD70, CD72, CD73, CD74, CD75, CD75S, CD77, CD79a, CD79b, CD80, CD81, CD82, CD83, CD84, CD85E, CD85I, CD85J, CD86, CD92, CD95, CD97, CD98, CD99, CD100, CD102, CD108, CD119, CD120a, CD120b, CD121b, CD122, CD124, CD125, CD126, CD130, CD132, CD137, CD138, CD139, CD147, CD148, CD150, CD152, CD162, CD164, CD166, CD167a, CD170, CD171, CD175, CD175s, CD180, CD184, CD185, CD192, CD196, CD197, CD200, CD205, CD201a, CDw210b, CD212, CD213a1, CD213a2, CD215, CD217, CD218a, CD218b, CD220, CD221, CD222, CD224, CD225, CD226, CD227, CD229, CD230, CD232, CD252, CD252, CD254, CD255, CD256, CD257 CD258, CD259, CD260, CD261, CD262, CD263, CD264, CD267, CD268, CD269, CD270, CD272, CD274, CD275, CD277, CD279, CD283, CD289, CD290, CD295, CD298, CD300, CD300c, CD305, CD306, CD307a, CD307b, CD307c, CD307d, CD307e, CD314, CD215, CD316, CD317, CD319, CD321, CD327, CD328, CD329, CD338, CD351, CD352, CD353, CD354, CD355, CD356, CD357, CD358, CD360, CD361, CD362, or CD363 antigen. In some embodiments, the B cell antigen is a CD1a antigen. In some embodiments, the B cell antigen is a CD1b antigen. In some embodiments, the B cell antigen is a CD1c antigen. In some embodiments, the B cell antigen is a CD1d antigen. In some embodiments, the B cell antigen is a CD2 antigen. In some embodiments, the B cell antigen is a CD5 antigen. In some embodiments, the B cell antigen is a CD6 antigen. In some embodiments, the B cell antigen is a CD9 antigen. In some embodiments, the B cell antigen is a CD11a antigen. In some embodiments, the B cell antigen is a CD11b antigen. In some embodiments, the B cell antigen is a CD11c antigen. In some embodiments, the B cell antigen is a CD17 antigen. In some embodiments, the B cell antigen is a CD18 antigen. In some embodiments, the B cell antigen is a CD19 antigen. In some embodiments, the B cell antigen is a CD20 antigen. In some embodiments, the B cell antigen is a CD21 antigen. In some embodiments, the B cell antigen is a CD22 antigen. In some embodiments, the B cell antigen is a CD23 antigen. In some embodiments, the B cell antigen is a CD24 antigen. In some embodiments, the B cell antigen is a CD25 antigen. In some embodiments, the B cell antigen is a CD26 antigen. In some embodiments, the B cell antigen is a CD27 antigen. In some embodiments, the B cell antigen is a CD29 antigen. In some embodiments, the B cell antigen is a CD30 antigen. In some embodiments, the B cell antigen is a CD31 antigen. In some embodiments, the B cell antigen is a CD32a antigen. In some embodiments, the B cell antigen is a CD32b antigen. In some embodiments, the B cell antigen is a CD35 antigen. In some embodiments, the B cell antigen is a CD37 antigen. In some embodiments, the B cell antigen is a CD38 antigen. In some embodiments, the B cell antigen is a CD39 antigen. In some embodiments, the B cell antigen is a CD40 antigen. In some embodiments, the B cell antigen is a CD45 antigen. In some embodiments, the B cell antigen is a CD45RA antigen. In some embodiments, the B cell antigen is a CD45RB antigen. In some embodiments, the B cell antigen is a CD45RC antigen. In some embodiments, the B cell antigen is a CD45RO antigen. In some embodiments, the B cell antigen is a CD46 antigen. In some embodiments, the B cell antigen is a CD47 antigen. In some embodiments, the B cell antigen is a CD48 antigen. In some embodiments, the B cell antigen is a CD49b antigen. In some embodiments, the B cell antigen is a CD49c antigen. In some embodiments, the B cell antigen is a CD49d antigen. In some embodiments, the B cell antigen is a CD50 antigen. In some embodiments, the B cell antigen is a CD52 antigen. In some embodiments, the B cell antigen is a CD53 antigen. In some embodiments, the B cell antigen is a CD54 antigen. In some embodiments, the B cell antigen is a CD55 antigen. In some embodiments, the B cell antigen is a CD58 antigen. In some embodiments, the B cell antigen is a CD60a antigen. In some embodiments, the B cell antigen is a CD62L antigen. In some embodiments, the B cell antigen is a CD63 antigen. In some embodiments, the B cell antigen is a CD68 antigen. In some embodiments, the B cell antigen is a CD69 antigen. In some embodiments, the B cell antigen is a CD70 antigen. In some embodiments, the B cell antigen is a CD72 antigen. In some embodiments, the B cell antigen is a CD73 antigen. In some embodiments, the B cell antigen is a CD74 antigen. In some embodiments, the B cell antigen is a CD75 antigen. In some embodiments, the B cell antigen is a CD75S antigen. In some embodiments, the B cell antigen is a CD77 antigen. In some embodiments, the B cell antigen is a CD79a antigen. In some embodiments, the B cell antigen is a CD79b antigen. In some embodiments, the B cell antigen is a CD80 antigen. In some embodiments, the B cell antigen is a CD81 antigen. In some embodiments, the B cell antigen is a CD82 antigen. In some embodiments, the B cell antigen is a CD83 antigen. In some embodiments, the B cell antigen is a CD84 antigen. In some embodiments, the B cell antigen is a CD85E antigen. In some embodiments, the B cell antigen is a CD85I antigen. In some embodiments, the B cell antigen is a CD85J antigen. In some embodiments, the B cell antigen is a CD86 antigen. In some embodiments, the B cell antigen is a CD92 antigen. In some embodiments, the B cell antigen is a CD95 antigen. In some embodiments, the B cell antigen is a CD97 antigen. In some embodiments, the B cell antigen is a CD98 antigen. In some embodiments, the B cell antigen is a CD99 antigen. In some embodiments, the B cell antigen is a CD100 antigen. In some embodiments, the B cell antigen is a CD102 antigen. In some embodiments, the B cell antigen is a CD108 antigen. In some embodiments, the B cell antigen is a CD119 antigen. In some embodiments, the B cell antigen is a CD120a antigen. In some embodiments, the B cell antigen is a CD120b antigen. In some embodiments, the B cell antigen is a CD121b antigen. In some embodiments, the B cell antigen is a CD122 antigen. In some embodiments, the B cell antigen is a CD124 antigen. In some embodiments, the B cell antigen is a CD125 antigen. In some embodiments, the B cell antigen is a CD126 antigen. In some embodiments, the B cell antigen is a CD130 antigen. In some embodiments, the B cell antigen is a CD132 antigen. In some embodiments, the B cell antigen is a CD137 antigen. In some embodiments, the B cell antigen is a CD138 antigen. In some embodiments, the B cell antigen is a CD139 antigen. In some embodiments, the B cell antigen is a CD147 antigen. In some embodiments, the B cell antigen is a CD148 antigen. In some embodiments, the B cell antigen is a CD150 antigen. In some embodiments, the B cell antigen is a CD152 antigen. In some embodiments, the B cell antigen is a CD162 antigen. In some embodiments, the B cell antigen is a CD164 antigen. In some embodiments, the B cell antigen is a CD166 antigen. In some embodiments, the B cell antigen is a CD167a antigen. In some embodiments, the B cell antigen is a CD170 antigen. In some embodiments, the B cell antigen is a CD171 antigen. In some embodiments, the B cell antigen is a CD175 antigen. In some embodiments, the B cell antigen is a CD175s antigen. In some embodiments, the B cell antigen is a CD180 antigen. In some embodiments, the B cell antigen is a CD184 antigen. In some embodiments, the B cell antigen is a CD185 antigen. In some embodiments, the B cell antigen is a CD192 antigen. In some embodiments, the B cell antigen is a CD196 antigen. In some embodiments, the B cell antigen is a CD197 antigen. In some embodiments, the B cell antigen is a CD200 antigen. In some embodiments, the B cell antigen is a CD205 antigen. In some embodiments, the B cell antigen is a CD201a antigen. In some embodiments, the B cell antigen is a CDw210b antigen. In some embodiments, the B cell antigen is a CD212 antigen. In some embodiments, the B cell antigen is a CD213a1 antigen. In some embodiments, the B cell antigen is a CD213a2 antigen. In some embodiments, the B cell antigen is a CD215 antigen. In some embodiments, the B cell antigen is a CD217 antigen. In some embodiments, the B cell antigen is a CD218a antigen. In some embodiments, the B cell antigen is a CD218b antigen. In some embodiments, the B cell antigen is a CD220 antigen. In some embodiments, the B cell antigen is a CD221 antigen. In some embodiments, the B cell antigen is a CD222 antigen. In some embodiments, the B cell antigen is a CD224 antigen. In some embodiments, the B cell antigen is a CD225 antigen. In some embodiments, the B cell antigen is a CD226 antigen. In some embodiments, the B cell antigen is a CD227 antigen. In some embodiments, the B cell antigen is a CD229 antigen. In some embodiments, the B cell antigen is a CD230 antigen. In some embodiments, the B cell antigen is a CD232 antigen. In some embodiments, the B cell antigen is a CD252 antigen. In some embodiments, the B cell antigen is a CD252 antigen. In some embodiments, the B cell antigen is a CD254 antigen. In some embodiments, the B cell antigen is a CD255 antigen. In some embodiments, the B cell antigen is a CD256 antigen. In some embodiments, the B cell antigen is a CD257 CD258 antigen. In some embodiments, the B cell antigen is a CD259 antigen. In some embodiments, the B cell antigen is a CD260 antigen. In some embodiments, the B cell antigen is a CD261 antigen. In some embodiments, the B cell antigen is a CD262 antigen. In some embodiments, the B cell antigen is a CD263 antigen. In some embodiments, the B cell antigen is a CD264 antigen. In some embodiments, the B cell antigen is a CD267 antigen. In some embodiments, the B cell antigen is a CD268 antigen. In some embodiments, the B cell antigen is a CD269 antigen. In some embodiments, the B cell antigen is a CD270 antigen. In some embodiments, the B cell antigen is a CD272 antigen. In some embodiments, the B cell antigen is a CD274 antigen. In some embodiments, the B cell antigen is a CD275 antigen. In some embodiments, the B cell antigen is a CD277 antigen. In some embodiments, the B cell antigen is a CD279 antigen. In some embodiments, the B cell antigen is a CD283 antigen. In some embodiments, the B cell antigen is a CD289 antigen. In some embodiments, the B cell antigen is a CD290 antigen. In some embodiments, the B cell antigen is a CD295 antigen. In some embodiments, the B cell antigen is a CD298 antigen. In some embodiments, the B cell antigen is a CD300 antigen. In some embodiments, the B cell antigen is a CD300c antigen. In some embodiments, the B cell antigen is a CD305 antigen. In some embodiments, the B cell antigen is a CD306 antigen. In some embodiments, the B cell antigen is a CD307a antigen. In some embodiments, the B cell antigen is a CD307b antigen. In some embodiments, the B cell antigen is a CD307c antigen. In some embodiments, the B cell antigen is a CD307d antigen. In some embodiments, the B cell antigen is a CD307e antigen. In some embodiments, the B cell antigen is a CD314 antigen. In some embodiments, the B cell antigen is a CD215 antigen. In some embodiments, the B cell antigen is a CD316 antigen. In some embodiments, the B cell antigen is a CD317 antigen. In some embodiments, the B cell antigen is a CD319 antigen. In some embodiments, the B cell antigen is a CD321 antigen. In some embodiments, the B cell antigen is a CD327 antigen. In some embodiments, the B cell antigen is a CD328 antigen. In some embodiments, the B cell antigen is a CD329 antigen. In some embodiments, the B cell antigen is a CD338 antigen. In some embodiments, the B cell antigen is a CD351 antigen. In some embodiments, the B cell antigen is a CD352 antigen. In some embodiments, the B cell antigen is a CD353 antigen. In some embodiments, the B cell antigen is a CD354 antigen. In some embodiments, the B cell antigen is a CD355 antigen. In some embodiments, the B cell antigen is a CD356 antigen. In some embodiments, the B cell antigen is a CD357 antigen. In some embodiments, the B cell antigen is a CD358 antigen. In some embodiments, the B cell antigen is a CD360 antigen. In some embodiments, the B cell antigen is a CD361 antigen. In some embodiments, the B cell antigen is a CD362 antigen. In some embodiments, the B cell antigen is a CD363 antigen.

In some embodiments, the antibody specifically binds Vβ17. In other embodiments, the Vβ17 is present on the surface of a T cell. In some embodiments, the antibody is a humanized antibody. In certain embodiments, the antibody is an IgG antibody. In other embodiments, the IgG antibody is an IgG1, IgG2, IgG3, or IgG4 antibody. In some embodiments, the antibody is a bispecific antibody. In certain embodiments, the antibody is multivalent. In other embodiments, the antibody is capable of binding at least three antigens. In some embodiments, the antibody is capable of binding at least four antigens. In some embodiments, the antibody is capable of binding at least five antigens.

In some aspects, provided is a multispecific antibody comprising a bispecific antibody provided herein. In some embodiments, the multispecific antibody is a Vβ17/CD123 antibody. In some embodiments, the multispecific antibody is a Vβ17/BCMA antibody. In some embodiments, the multispecific antibody is a Vβ17/DLL3 antibody. In some embodiments, the multispecific antibody is a Vβ17/PSMA antibody. In some embodiments, the multispecific antibody is a Vβ17/KLK2 antibody.

In one aspect, provided herein is an antibody that binds to Vα10.2. In some embodiments, the antibody comprises a heavy chain variable region and a light chain variable region. In a some embodiments, the Vα10.2 antibody is not a single domain antibody or nanobody. In some embodiments, the Vα10.2 antibody is a humanized antibody.

In certain embodiments, provided herein is an anti-Vα10.2 antibody comprising a VH region, VL region, VH CDR1, VH CDR2, VH CDR3, VL CDR1, VL CDR2, and/or VL CDR3 of any one of the antibodies described herein. In some embodiments, provided herein is an anti-Vα10.2 antibody comprising a VH region of any one of the antibodies described herein. In some embodiments, provided herein is an anti-Vα10.2 antibody comprising a VL region of any one of the antibodies described herein. In some embodiments, provided herein is an anti-Vα10.2 antibody comprising a VH region of any one of the antibodies described herein, and a VL region of any one of the antibodies described herein. In some embodiments, provided herein is an anti-Vα10.2 antibody comprising a VH CDR1, VH CDR2, and VH CDR3 of any one of the antibodies described herein. In some embodiments, provided herein is an anti-Vα10.2 antibody comprising a VL CDR1, VL CDR2, and VL CDR3 of any one of the antibodies described herein. In some embodiments, provided herein is an anti-Vα10.2 antibody comprising a VH CDR1, VH CDR2, and VH CDR3 of any one of the antibodies described herein; and a VL CDR1, VL CDR2, and VL CDR3 of any one of the antibodies described herein. Representative VH and VL amino acid sequences, including VH CDR1, VH CDR2, VH CDR3, VL CDR1, VL CDR2 and VL CDR3 amino acid sequences, of Vα10.2 antibodies provided herein are provided in the Sequence Listing, as well as Tables 1-21. In certain embodiments, the Vα10.2 antibody comprises a VH CDR1, VH CDR2 and VH CDR3 of the VH region of SEQ ID NO:568. In certain embodiments, the Vα10.2 antibody comprises a VL CDR1, VL CDR2 and VL CDR3 of the VL region of SEQ ID NO:569. In certain embodiments, the Vα10.2 antibody comprises a VH CDR1, VH CDR2 and VH CDR3 of the VH region of SEQ ID NO:568, and a VL CDR1, VL CDR2 and VL CDR3 of the VL region of SEQ ID NO:569. In certain embodiments, the Vα10.2 antibody comprises a VH CDR1, VH CDR2 and VH CDR3 of the VH region of SEQ ID NO:570. In certain embodiments, the Vα10.2 antibody comprises a VL CDR1, VL CDR2 and VL CDR3 of the VL region of SEQ ID NO:571. In certain embodiments, the Vα10.2 antibody comprises a VH CDR1, VH CDR2 and VH CDR3 of the VH region of SEQ ID NO:570, and a VL CDR1, VL CDR2 and VL CDR3 of the VL region of SEQ ID NO:571. In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system.

In certain embodiments, provided herein is an anti-Vα10.2 multispecific antibody comprising a binding domain that binds to Vα10.2 having a VH region, VL region, VH CDR1, VH CDR2, VH CDR3, VL CDR1, VL CDR2, and/or VL CDR3 of any one of the antibodies described herein. In some embodiments, provided herein is an anti-Vα10.2 multispecific antibody comprising a binding domain that binds to Vα10.2 having a VH region of any one of the antibodies described herein. In some embodiments, provided herein is an anti-Vα10.2 multispecific antibody comprising a binding domain that binds to Vα10.2 having a VL region of any one of the antibodies described herein. In some embodiments, provided herein is an anti-Vα10.2 multispecific antibody comprising a binding domain that binds to Vα10.2 having a VH region of any one of the antibodies described herein, and a VL region of any one of the antibodies described herein. In some embodiments, provided herein is an anti-Vα10.2 multispecific antibody comprising a binding domain that binds to Vα10.2 having a VH CDR1, VH CDR2, and VH CDR3 of any one of the antibodies described. In some embodiments, provided herein is an anti-Vα10.2 multispecific antibody comprising a binding domain that binds to Vα10.2 having a VL CDR1, VL CDR2, and VL CDR3 of any one of the antibodies described herein. In some embodiments, provided herein is an anti-Vα10.2 multispecific antibody comprising a binding domain that binds to Vα10.2 having a VH CDR1, VH CDR2, and VH CDR3 of any one of the antibodies described herein; and a VL CDR1, VL CDR2, and VL CDR3 of any one of the antibodies described herein. In some embodiments, provided herein is an anti-Vα10.2 multispecific antibody comprising a binding domain that binds to Vα10.2 having a VH CDR1, VH CDR2 and VH CDR3 of the VH region of SEQ ID NO:568. In some embodiments, provided herein is an anti-Vα10.2 multispecific antibody comprising a binding domain that binds to Vα10.2 having a VL CDR1, VL CDR2 and VL CDR3 of the VL region of SEQ ID NO:569. In some embodiments, provided herein is an anti-Vα10.2 multispecific antibody comprising a binding domain that binds to Vα10.2 having a VH CDR1, VH CDR2 and VH CDR3 of the VH region of SEQ ID NO:568, and a VL CDR1, VL CDR2 and VL CDR3 of the VL region of SEQ ID NO:569. In some embodiments, provided herein is an anti-Vα10.2 multispecific antibody comprising a binding domain that binds to Vα10.2 having a VH CDR1, VH CDR2 and VH CDR3 of the VH region of SEQ ID NO:570. In some embodiments, provided herein is an anti-Vα10.2 multispecific antibody comprising a binding domain that binds to Vα10.2 having a VL CDR1, VL CDR2 and VL CDR3 of the VL region of SEQ ID NO:571. In some embodiments, provided herein is an anti-Vα10.2 multispecific antibody comprising a binding domain that binds to Vα10.2 having a VH CDR1, VH CDR2 and VH CDR3 of the VH region of SEQ ID NO:570, and a VL CDR1, VL CDR2 and VL CDR3 of the VL region of SEQ ID NO:571. Inn certain embodiments, the multispecific antibody is a bispecific antibody. In some embodiments, the multispecific antibody. In some embodiments, the VH CDR1, VH CDR2, VH CDR3, VL CDR1, VL CDR2, and VL CDR3 sequences are according to the Kabat numbering system. In some embodiments, the VH CDR1, VH CDR2, VH CDR3, VL CDR1, VL CDR2, and VL CDR3 sequences are according to the Chothia numbering system. In some embodiments, the VH CDR1, VH CDR2, VH CDR3, VL CDR1, VL CDR2, and VL CDR3 sequences are according to the Exemplary numbering system. In some embodiments, the VH CDR1, VH CDR2, VH CDR3, VL CDR1, VL CDR2, and VL CDR3 sequences are according to the Contact numbering system. In some embodiments, the VH CDR1, VH CDR2, VH CDR3, VL CDR1, VL CDR2, and VL CDR3 sequences are according to the IMGT numbering system. In some embodiments, the VH CDR1, VH CDR2, VH CDR3, VL CDR1, VL CDR2, and VL CDR3 sequences are according to the AbM numbering system.

In certain embodiments, provided is an anti-Vα10.2 antibody that is an intact antibody. In other embodiments, provided is an anti-Vα10.2 antibody is an antigen binding fragment of the anti-Vα10.2 antibody. In some embodiments, the antigen binding fragment of the anti-Vα10.2 antibody is a functional fragment. In some embodiments, the antigen binding fragment is a diabody. In some embodiments, the antigen binding fragment is a Fab. In some embodiments, the antigen binding fragment is a Fab'. In some embodiments, the antigen binding fragment is a F(ab')2. In some embodiments, the antigen binding fragment is a Fv fragment. In some embodiments, the antigen binding fragment is a disulfide stabilized Fv fragment (dsFv). In some embodiments, the antigen binding fragment is a (dsFv)$_2$. In some embodiments, the antigen binding fragment is a bispecific dsFv (dsFv-dsFv'). In some embodiments, the antigen binding fragment is a disulfide stabilized diabody (ds diabody). In some embodiments, the antigen binding fragment is a single-chain antibody molecule (scFv). In some embodiments, the antigen binding fragment is a single domain antibody (sdAb). In some embodiments, the antigen binding fragment is an scFv dimer (bivalent diabody). In some embodiments, the antigen binding fragment is a multispecific antibody formed from a portion of an antibody comprising one or more CDRs. In some embodiments, the antigen binding fragment is a camelized single domain antibody. In some embodiments, the antigen binding fragment is a nanobody. In some embodiments, the antigen binding fragment is a domain antibody. In some embodiments, the antigen binding fragment is a bivalent domain antibody. In some embodiments, the antigen binding fragment is an antibody fragment that binds to an antigen but does not comprise a complete antibody structure.

In some embodiments, the antibody specifically binds Vα10.2. In other embodiments, the Vα10.2 is present on the surface of a T cell. In some embodiments, the antibody is a humanized antibody. In certain embodiments, the antibody is an IgG antibody. In other embodiments, the IgG antibody is an IgG1, IgG2, IgG3, or IgG4 antibody. In some embodiments, the antibody is a bispecific antibody. In certain embodiments, the antibody is multivalent. In other embodiments, the antibody is capable of binding at least three antigens. In other embodiments, the antibody is capable of binding at least four antigens. \ In some embodiments, the antibody is capable of binding at least five antigens.

The binding site for a second antigen can of a multispecific antibody provided herein, for example, bind a cancer antigen present on the surface of a cancer cell. The binding of the Vβ17 bispecific antibody to Vβ17 present on the surface of the T cell, and the binding of tumor associated antigen present on the surface of the cancer cell can, for example, result in the killing of the cancer cell.

In some embodiments, the bispecific antibody provided herein is a diabody, a cross-body, or a bispecific antibody obtained via a controlled Fab arm exchange as those described herein.

In some embodiments, the bispecific antibodies include IgG-like molecules with complementary CH3 domains that promote heterodimerization; recombinant IgG-like dual targeting molecules, wherein the two sides of the molecule each contain the Fab fragment or part of the Fab fragment of at least two different antibodies; IgG fusion molecules, wherein full length IgG antibodies are fused to an extra Fab fragment or parts of Fab fragment; Fc fusion molecules, wherein single chain Fv molecules or stabilized diabodies are fused to heavy-chain constant-domains, Fc-regions or parts thereof; Fab fusion molecules, wherein different Fab-fragments are fused together; ScFv- and diabody-based and heavy chain antibodies (e.g., domain antibodies, nanobodies) wherein different single chain Fv molecules or different diabodies or different heavy-chain antibodies (e.g. domain antibodies, nanobodies) are fused to each other or to another protein or carrier molecule.

In some embodiments, IgG-like molecules with complementary CH3 domains molecules include the Triomab/Quadroma (Trion Pharma/Fresenius Biotech), the Knobs-into-Holes (Genentech), CrossMAbs (Roche) and the electrostatically-matched (Amgen), the LUZ-Y (Genentech), the Strand Exchange Engineered Domain body (SEEDbody) (EMD Serono), the Biclonic (Merus) and the DuoBody (Genmab A/S).

In some embodiments, recombinant IgG-like dual targeting molecules include Dual Targeting (DT)-Ig (GSK/Domantis), Two-in-one Antibody (Genentech), Cross-linked Mabs (Karmanos Cancer Center), mAb2 (F-Star) and CovX-body (CovX/Pfizer).

In some embodiments, IgG fusion molecules include Dual Variable Domain (DVD)-Ig (Abbott), IgG-like Bispecific (InnClone/Eli Lilly), Ts2Ab (MedImmune/AZ) and BsAb (Zymogenetics), HERCULES (Biogen Idec) and TvAb (Roche).

In some embodiments, Fc fusion molecules can include ScFv/Fc Fusions (Academic Institution), SCORPION (Emergent BioSolutions/Trubion, Zymogenetics/BMS), Dual Affinity Retargeting Technology (Fc-DART) (MacroGenics) and Dual (ScFv)$_2$-Fab (National Research Center for Antibody Medicine—China).

In some embodiments, Fab fusion bispecific antibodies include F(ab)$_2$ (Medarex/AMGEN), Dual-Action or Bis-Fab (Genentech), Dock-and-Lock (DNL) (ImmunoMedics), Bivalent Bispecific (Biotecnol) and Fab-Fv (UCB-Celltech). ScFv-, diabody-based, and domain antibodies, include but are not limited to, Bispecific T Cell Engager (BiTE) (Micromet), Tandem Diabody (Tandab) (Affimed), Dual Affinity Retargeting Technology (DART) (MacroGenics), Single-chain Diabody (Academic), TCR-like Antibodies (AIT, ReceptorLogics), Human Serum Albumin ScFv Fusion (Merrimack) and COMBODY (Epigen Biotech), dual targeting nanobodies (Ablynx), dual targeting heavy chain only domain antibodies.

Full length bispecific antibodies provided herein can be generated for example using Fab arm exchange (or half molecule exchange) between two mono specific bivalent antibodies by introducing substitutions at the heavy chain CH3 interface in each half molecule to favor heterodimer formation of two antibody half molecules having distinct specificity either in vitro in cell-free environment or using co-expression. The Fab arm exchange reaction is the result of a disulfide-bond isomerization reaction and dissociation-association of CH3 domains. The heavy-chain disulfide bonds in the hinge regions of the parent mono specific antibodies are reduced. The resulting free cysteines of one of the parent monospecific antibodies form an inter heavy-chain disulfide bond with cysteine residues of a second parent mono specific antibody molecule and simultaneously CH3 domains of the parent antibodies release and reform by dissociation-association. The CH3 domains of the Fab arms can be engineered to favor heterodimerization over homodimerization. The resulting product is a bispecific antibody having two Fab arms or half molecules which each binding a distinct epitope, i.e. an epitope on Vβ17 and an epitope on a second target antigen (e.g., not Vβ17).

"Homodimerization" as used herein refers to an interaction of two heavy chains having identical CH3 amino acid sequences. "Homodimer" as used herein refers to an antibody having two heavy chains with identical CH3 amino acid sequences.

"Heterodimerization" as used herein refers to an interaction of two heavy chains having non-identical CH3 amino acid sequences. "Heterodimer" as used herein refers to an antibody having two heavy chains with non-identical CH3 amino acid sequences.

The "knob-in-hole" strategy (see, e.g., PCT Publ. No. WO2006/028936) can be used to generate full length bispecific antibodies. Briefly, selected amino acids forming the interface of the CH3 domains in human IgG can be mutated at positions affecting CH3 domain interactions to promote heterodimer formation. An amino acid with a small side chain (hole) is introduced into a heavy chain of an antibody specifically binding a first antigen and an amino acid with a large side chain (knob) is introduced into a heavy chain of an antibody specifically binding a second antigen. After co-expression of the two antibodies, a heterodimer is formed as a result of the preferential interaction of the heavy chain with a "hole" with the heavy chain with a "knob." Exemplary CH3 substitution pairs forming a knob and a hole are (expressed as modified position in the first CH3 domain of the first heavy chain/modified position in the second CH3 domain of the second heavy chain): T366Y/F405A, T366W/F405W, F405W/Y407A, T394W/Y407T, T394S/Y407A, T366W/T394S, F405W/T394S and T366W/T366S_L368A_Y407V.

Other strategies such as promoting heavy chain heterodimerization using electrostatic interactions by substituting positively charged residues at one CH3 surface and negatively charged residues at a second CH3 surface can be used, as described in US Pat. Publ. No. US2010/0015133; US Pat. Publ. No. US2009/0182127; US Pat. Publ. No. US2010/028637; or US Pat. Publ. No. US2011/0123532. In other strategies, heterodimerization can be promoted by the following substitutions (expressed as modified position in the first CH3 domain of the first heavy chain/modified position in the second CH3 domain of the second heavy chain): L351Y_F405AY407V/T394W, T366I_K392M_T394W/

F405A_Y407V, T366L_K392M_T394W/F405A_Y407V, L351Y_Y407A/T366A_K409F, L351Y_Y407A/T366V_K409F Y407A/T366A_K409F, or T350V_L351Y_F405A Y407V/T350V_T366L_K392L_T394W as described in U.S. Pat. Publ. No. US2012/0149876 or U.S. Pat. Publ. No. US2013/0195849.

In addition to methods described above, bispecific antibodies provided herein can be generated in vitro in a cell-free environment by introducing asymmetrical mutations in the CH3 regions of two mono specific homodimeric antibodies and forming the bispecific heterodimeric antibody from two parent monospecific homodimeric antibodies in reducing conditions to allow disulfide bond isomerization according to methods described in PCT Pat. Publ. No. WO2011/131746. In the methods, the first monospecific bivalent antibody and the second monospecific bivalent antibody are engineered to have certain substitutions at the CH3 domain that promotes heterodimer stability; the antibodies are incubated together under reducing conditions sufficient to allow the cysteines in the hinge region to undergo disulfide bond isomerization; thereby generating the bispecific antibody by Fab arm exchange. The incubation conditions can optionally be restored to non-reducing conditions. Exemplary reducing agents that can be used are 2-mercaptoethylamine (2-MEA), dithiothreitol (DTT), dithioerythritol (DTE), glutathione, tris (2-carboxyethyl) phosphine (TCEP), L-cysteine and beta-mercaptoethanol, preferably a reducing agent selected from the group consisting of: 2-mercaptoethylamine, dithiothreitol and tris (2-carboxyethyl) phosphine. For example, incubation for at least 90 min at a temperature of at least 20° C. in the presence of at least 25 mM 2-MEA or in the presence of at least 0.5 mM dithiothreitol at a pH from 5-8, for example at pH of 7.0 or at pH of 7.4 can be used.

In certain embodiments, the anti-Vβ17 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:

a. SEQ ID NOs:1, 2, 3, 4, 5, and 6, respectively;
and the anti-CD123 antibody or antigen-binding fragment thereof comprises a heavy chain complementarity determining region 1 (HCDR1), HCDR2, HCDR3, a light chain complementarity determining region 1 (LCDR1), LCDR2, and LCDR3, having the polypeptide sequence of:
1. SEQ ID NOs:34, 35, 36, 37, 38, and 39, respectively.

According to another particular aspect, the invention relates to an isolated anti-Vβ17/anti-CD123 bispecific antibody or antigen-binding fragment thereof that induces antibody-dependent cell-mediated cytotoxicity (ADCC). The bispecific antibody or antigen-binding fragment thereof can, for example, induce ADCC in vitro. The bispecific antibody or antigen-binding fragment thereof can induce ADCC with an $EC_{50}$ of less than about 1 pM. In certain embodiments, the anti-Vβ17/anti-CD123 bispecific antibody or antigen-binding fragment thereof comprises an IgG1, IgG2, IgG3, or IgG4 backbone. In one such embodiment, the anti-Vβ17/anti-CD123 bispecific antibody or antigen-binding fragment thereof has an antibody backbone of the IgG4 isotype.

In some embodiments described herein, ADCC elicited by the anti-Vβ17/anti-CD123 bispecific antibodies can also be enhanced by certain substitutions in the antibody Fc. Exemplary substitutions include, for example, substitutions at amino acid positions 256, 290, 298, 312, 356, 330, 333, 334, 360, 378 or 430 (residue numbering according to the EU index) as described in U.S. Pat. No. 6,737,056.

According to another particular aspect, the invention relates to an isolated anti-Vβ17/anti-CD123 bispecific antibody or antigen-binding fragment thereof capable of inducing T-cell dependent cytotoxicity in Vβ17-expressing cells and/or CD123-expressing cells. The bispecific antibody or antigen-binding fragment thereof can, for example, induce T-cell dependent cytotoxicity in Vβ17-expressing cells and/or CD123-expressing cells in vitro with an $EC_{50}$ value of less than about 2 nM. In certain embodiments, the $EC_{50}$ is less than about 2.0 nM, less than about 1.9 nM, less than about 1.8 nM, less than about 1.7 nM, less than about 1.6 nM, less than about 1.5 nM, less than about 1.4 nM, less than about 1.3 nM, less than about 1.2 nM, less than about 1.1 nM, less than about 1.0 nM, less than about 0.9 nM, less than about 0.8 nM, less than about 0.7 nM, less than about 0.6 nM, less than about 0.5 nM, less than about 0.4 nM, less than about 0.3 nM, less than about 0.2 nM, and less than about 0.1 nM.

In some embodiments, the anti-Vβ17 antibody is a multispecific antibody. In other embodiments, the anti-Vβ17 antibody is a bispecific antibody. In other embodiments, the bispecific antibody comprises an antigen binding fragment of an anti-Vβ17 antibody provided herein.

In some embodiments, the anti-Vβ17 bispecific antibody does not comprise a single chain antibody. In some embodiments, the anti-Vβ17 bispecific antibody does not comprise a single domain antibody. In certain embodiments, the anti-Vβ17 bispecific antibody does not comprise a nanobody. In certain embodiments, the anti-Vβ17 bispecific antibody does not comprise a VI-11-1 antibody. In certain embodiments, the anti-Vβ17 bispecific antibody does not comprise a llama antibody.

According to another particular aspect, the invention relates to an isolated anti-Vβ17 bispecific antibody or antigen-binding fragment thereof that induces antibody-dependent cell-mediated cytotoxicity (ADCC). The bispecific antibody or antigen-binding fragment thereof can, for example, induce ADCC in vitro.

In certain embodiments, the bispecific antibody or antigen-binding fragment thereof induces T cell dependent cytotoxicity of a second cell in vitro with an $EC_{50}$ of less than about 160 pM, when assessed in vitro at an effector to target cell ratio of 1:1.

In some embodiments, Vβ17 is present on the surface of a T cell. In some embodiments, the Vβ17 is present on the surface of a T cell, and the second target antigen is on the surface of a second cell. In some embodiments, the second cell is killed when the bispecific antibody binds to the Vβ17 on the surface of the T cell and the second target antigen on the surface of the second cell. In some embodiments, the bispecific antibody induces T cell dependent cytotoxicity of the second cell in vitro with an $EC_{50}$ of less than about 500 pM. In some embodiments, the bispecific antibody induces T cell dependent cytotoxicity of the second cell in vitro with an $EC_{50}$ of less than about 300 pM. In some embodiments, the bispecific antibody induces T cell dependent cytotoxicity of the second cell in vitro with an $EC_{50}$ of less than about 160 pM. In some embodiments, the $EC_{50}$ is assessed with a mixture of αβ T effector cells and target cells expressing the second target antigen. In some embodiments, the effector cell to target cell ratio is about 0.01 to 1 to about 5 to 1. In some embodiments, the effector cell to target cell ratio is about 0.1 to 1 to about 2 to 1. In some embodiments, the effector cell to target cell ratio is about 1:1.

In certain embodiments, the $EC_{50}$ is less than about 1 pM, less than about 0.9 pM, less than about 0.8 pM, less than about 0.7 pM, less than about 0.6 pM, less than about 0.5 pM, less than about 0.4 pM, less than about 0.300 pM, less than about 0.2 pM, less than about 0.19 pM, less than about 0.18 pM, less than about 0.17 pM, less than about 0.16 pM, less than about 0.15 pM, less than about 0.14 pM, less than about 0.13 pM, less than about 0.12 pM, less than about 0.11 pM, less than about 0.1 pM, less than about 0.09 pM, less than about 0.08 pM, less than about 0.07 pM, less than about 0.06 pM, less than about 0.05 pM, less than about 0.04 pM, less than about 0.03 pM, less than about 0.02 pM, or less than about 0.01 pM. In certain embodiments, the $EC_{50}$ is less than about 1000 pM, less than about 900 pM, less than about 800 pM, less than about 700 pM, less than about 600 pM, less than about 500 pM, less than about 400 pM, less than about 300 pM, less than about 200 pM, less than about 190 pM, less than about 180 pM, less than about 170 pM, less than about 160 pM, less than about 150 pM, less than about 140 pM, less than about 130 pM, less than about 120 pM, less than about 110 pM, less than about 100 pM, less than about 90 pM, less than about 80 pM, less than about 70 pM, less than about 60 pM, less than about 50 pM, less than about 40 pM, less than about 30 pM, less than about 20 pM, or less than about 10 pM.

In certain embodiments, the effector to target cell ratio can, for example, be 0.01:1, 0.02:1, 0.03:1, 0.04:1, 0.05:1, 0.06:1, 0.07:1, 0.08:1, 0.09:1, 1:1, 2:1, 3:1, 4:1, 5:1, 6:1, 7:1, 8:1, 9:1, or 10:1.

In certain embodiments, the concentration of the bispecific antibody or antigen-binding fragment thereof is about 0.000005 ng/mL, about 0.00005 ng/mL, about 0.0005 ng/mL, about 0.005 ng/mL, about 0.01 ng/mL, about 0.02 ng/mL, about 0.03 ng/mL, about 0.04 ng/mL, about 0.05 ng/mL, about 0.06 ng/mL, about 0.07 ng/mL, about 0.08 ng/mL, about 0.09 ng/mL, about 0.1 ng/mL, about 0.5 ng/mL, about 1.0 ng/mL, about 10 ng/mL, about 20 ng/mL about, about 30 ng/mL about 40 ng/mL, about 50 ng/mL, about 60 ng/mL, about 70 ng/mL, about 80 ng/mL, about 90 ng/mL, about 100 ng/mL, or about 1000 ng/mL.

In another aspect, provided herein is an antibody that competes for binding to Vβ17 with any of the Vβ17 antibodies described herein. In another aspect, provided herein is an antibody that binds to the same epitope as any of the Vβ17 antibodies described herein. In another aspect, provided is a Vβ17 antibody that binds an epitope on Vβ17 that overlaps with the epitope on Vβ17 bound by a Vβ17 antibody described herein. In some embodiments, the Vβ17 antibody comprises a VH CDR1, VH CDR2, and VH CDR3 of a Vβ17 antibody provided herein. In some embodiments, the Vβ17 antibody comprises a VL CDR1, VL CDR2, and VL CDR3 of a Vβ17 antibody provided herein. In some embodiments, the Vβ17 antibody comprises a VH CDR1, VH CDR2, VH CDR3, a VL CDR1, VL CDR2, and VL CDR3 of a Vβ17 antibody provided herein. In some embodiments, the Vβ17 antibody comprises a VH of a Vβ17 antibody provided herein. In some embodiments, the Vβ17 antibody comprises a VL of a Vβ17 antibody provided herein. In some embodiments, the Vβ17 antibody comprises a VH and a VL of a Vβ17 antibody provided herein. In some embodiments, the Vβ17 antibody comprises a VH CDR1, VH CDR2, VH CDR3, a VL CDR1, VL CDR2, and VL CDR3 of a Vβ17 antibody provided herein. In some embodiments, the VH CDR1, VH CDR2, VH CDR3, VL CDR1, VL CDR2, and VL CDR3 amino acid sequences of the Vβ17 antibody are according to the Kabat numbering system. In some embodiments, the VH CDR1, VH CDR2, VH CDR3, VL CDR1, VL CDR2, and VL CDR3 amino acid sequences of the Vβ17 antibody are according to the Chothia numbering system. In some embodiments, the VH CDR1, VH CDR2, VH CDR3, VL CDR1, VL CDR2, and VL CDR3 amino acid sequences of the Vβ17 antibody are according to the AbM numbering system. In some embodiments, the VH CDR1, VH CDR2, VH CDR3, VL CDR1, VL CDR2, and VL CDR3 amino acid sequences of the Vβ17 antibody are according to the Contact numbering system. In some embodiments, the VH CDR1, VH CDR2, VH CDR3, VL CDR1, VL CDR2, and VL CDR3 amino acid sequences of the Vβ17 antibody are according to the IMGT numbering system. In certain embodiments, the Vβ17 antibody is a multispecific antibody. In some embodiments, the Vβ17 antibody is a bispecific antibody.

In another aspect, provided is an antibody that competes for binding to Vβ17 with a Vβ17 reference antibody. In another aspect, provided is a Vβ17 antibody that binds to the same Vβ17 epitope as a Vβ17 reference antibody. In another aspect, provided is a Vβ17 antibody that binds an epitope on Vβ17 that overlaps with the epitope on Vβ17 bound by a Vβ17 reference antibody. In some embodiments, the Vβ17 reference antibody comprises a VH CDR1, VH CDR2, and VH CDR3 of a Vβ17 reference antibody provided herein. In some embodiments, the Vβ17 reference antibody comprises a VL CDR1, VL CDR2, and VL CDR3 of a Vβ17 reference antibody provided herein. In some embodiments, the Vβ17 reference antibody comprises a VH CDR1, VH CDR2, VH CDR3, a VL CDR1, VL CDR2, and VL CDR3 of a Vβ17 reference antibody provided herein. In some embodiments, the Vβ17 reference antibody comprises a VH of a Vβ17 reference antibody provided herein. In some embodiments, the Vβ17 reference antibody comprises a VL of a Vβ17 reference antibody provided herein. In some embodiments, the Vβ17 reference antibody comprises a VH and a VL of a Vβ17 reference antibody provided herein. In some embodiments, the Vβ17 reference antibody comprises a VH CDR1, VH CDR2, VH CDR3, a VL CDR1, VL CDR2, and VL CDR3 of a Vβ17 reference antibody provided herein. In some embodiments, the VH CDR1, VH CDR2, VH CDR3, VL CDR1, VL CDR2, and VL CDR3 amino acid sequences of the Vβ17 reference antibody are according to the Kabat numbering system. In some embodiments, the VH CDR1, VH CDR2, VH CDR3, VL CDR1, VL CDR2, and VL CDR3 amino acid sequences of the Vβ17 reference antibody are according to the Chothia numbering system. In some embodiments, the VH CDR1, VH CDR2, VH CDR3, VL CDR1, VL CDR2, and VL CDR3 amino acid sequences of the Vβ17 reference antibody are according to the AbM numbering system. In some embodiments, the VH CDR1, VH CDR2, VH CDR3, VL CDR1, VL CDR2, and VL CDR3 amino acid sequences of the Vβ17 reference antibody are according to the Contact numbering system. In some embodiments, the VH CDR1, VH CDR2, VH CDR3, VL CDR1, VL CDR2, and VL CDR3 amino acid sequences of the Vβ17 reference antibody are according to the IMGT numbering system. In certain embodiments, the antibody is a multispecific antibody. In some embodiments, the antibody is a bispecific antibody. In certain embodiments, the Vβ17 reference antibody is a multispecific antibody. In some embodiments, the Vβ17 reference antibody is a bispecific antibody.

In another aspect, provided herein is an antibody that competes for binding to Vα10.2 with any of the Vα10.2 antibodies described herein. In another aspect, provided herein is an antibody that binds to the same epitope as any of the Vα10.2 antibodies described herein. In another aspect, provided is a Vα10.2 antibody that binds an epitope on Vα10.2 that overlaps with the epitope on Vα10.2 bound by a Vα10.2 antibody described herein. In some embodiments, the Vα10.2 antibody comprises a VH CDR1, VH CDR2, and VH CDR3 of a Vα10.2 antibody provided herein. In some embodiments, the Vα10.2 antibody comprises a VL CDR1, VL CDR2, and VL CDR3 of a Vα10.2 antibody provided herein. In some embodiments, the Vα10.2 antibody comprises a VH CDR1, VH CDR2, VH CDR3, a VL CDR1, VL CDR2, and VL CDR3 of a Vα10.2 antibody provided herein. In some embodiments, the Vα10.2 antibody comprises a VH of a Vα10.2 antibody provided herein. In some embodiments, the Vα10.2 antibody comprises a VL of a Vα10.2 antibody provided herein. In some embodiments, the Vα10.2 antibody comprises a VH and a VL of a Vα10.2 antibody provided herein. In some embodiments, the Vα10.2 antibody comprises a VH CDR1, VH CDR2, VH CDR3, a VL CDR1, VL CDR2, and VL CDR3 of a Vα10.2 antibody provided herein. In some embodiments, the VH CDR1, VH CDR2, VH CDR3, VL CDR1, VL CDR2, and VL CDR3 amino acid sequences of the Vα10.2 antibody are according to the Kabat numbering system. In some embodiments, the VH CDR1, VH CDR2, VH CDR3, VL CDR1, VL CDR2, and VL CDR3 amino acid sequences of the Vα10.2 antibody are according to the Chothia numbering system. In some embodiments, the VH CDR1, VH CDR2, VH CDR3, VL CDR1, VL CDR2, and VL CDR3 amino acid sequences of the Vα10.2 antibody are according to the AbM numbering system. In some embodiments, the VH CDR1, VH CDR2, VH CDR3, VL CDR1, VL CDR2, and VL CDR3 amino acid sequences of the Vα10.2 antibody are according to the Contact numbering system. In some embodiments, the VH CDR1, VH CDR2, VH CDR3, VL CDR1, VL CDR2, and VL CDR3 amino acid sequences of the Vα10.2 antibody are according to the IMGT numbering system. In certain embodiments, the Vα10.2 antibody is a multispecific antibody. In some embodiments, the Vα10.2 antibody is a bispecific antibody.

In another aspect, provided is an antibody that competes for binding to Vα10.2 with a Vα10.2 reference antibody. In another aspect, provided is a Vα10.2 antibody that binds to the same Vα10.2 epitope as a Vα10.2 reference antibody. In another aspect, provided is a Vα10.2 antibody that binds an epitope on Vα10.2 that overlaps with the epitope on Vα10.2 bound by a Vα10.2 reference antibody. In some embodiments, the Vα10.2 reference antibody comprises a VH CDR1, VH CDR2, and VH CDR3 of a Vα10.2 reference antibody provided herein. In some embodiments, the Vα10.2 reference antibody comprises a VL CDR1, VL CDR2, and VL CDR3 of a Vα10.2 reference antibody provided herein. In some embodiments, the Vα10.2 reference antibody comprises a VH CDR1, VH CDR2, VH CDR3, a VL CDR1, VL CDR2, and VL CDR3 of a Vα10.2 reference antibody provided herein. In some embodiments, the Vα10.2 reference antibody comprises a VH of a Vα10.2 reference antibody provided herein. In some embodiments, the Vα10.2 reference antibody comprises a VL of a Vα10.2 reference antibody provided herein. In some embodiments, the Vα10.2 reference antibody comprises a VH and a VL of a Vα10.2 reference antibody provided herein. In some embodiments, the Vα10.2 reference antibody comprises a VH CDR1, VH CDR2, VH CDR3, a VL CDR1, VL CDR2, and VL CDR3 of a Vα10.2 reference antibody provided herein. In some embodiments, the VH CDR1, VH CDR2, VH CDR3, VL CDR1, VL CDR2, and VL CDR3 amino acid sequences of the Vα10.2 reference antibody are according to the Kabat numbering system. In some embodiments, the VH CDR1, VH CDR2, VH CDR3, VL CDR1, VL CDR2, and VL CDR3 amino acid sequences of the Vα10.2 reference antibody are according to the Chothia numbering system. In some embodiments, the VH CDR1, VH CDR2, VH CDR3, VL CDR1, VL CDR2, and VL CDR3 amino acid sequences of the Vα10.2 reference antibody are according to the AbM numbering system. In some embodiments, the VH CDR1, VH CDR2, VH CDR3, VL CDR1, VL CDR2, and VL CDR3 amino acid sequences of the Vα10.2 reference antibody are according to the Contact numbering system. In some embodiments, the VH CDR1, VH CDR2, VH CDR3, VL CDR1, VL CDR2, and VL CDR3 amino acid sequences of the Vα10.2 reference antibody are according to the IMGT numbering system. In certain embodiments, the antibody is a multispecific antibody. In some embodiments, the antibody is a bispecific antibody. In certain embodiments, the Vα10.2 reference antibody is a multispecific antibody. In some embodiments, the Vα10.2 reference antibody is a bispecific antibody.

In some embodiments described herein, immune effector properties of the anti-Vβ17 bispecific antibodies provided herein can be enhanced or silenced through Fc modifications by techniques known to those skilled in the art. For example, Fc effector functions such as C1q binding, complement dependent cytotoxicity (CDC), antibody-dependent cell-mediated cytotoxicity (ADCC), antibody-dependent cell-mediated phagocytosis (ADCP), down regulation of cell surface receptors (e.g., B cell receptor; BCR), etc. can be provided and/or controlled by modifying residues in the Fc responsible for these activities.

In some embodiments described herein, immune effector properties of the anti-Vβ17 bispecific antibodies can be enhanced or silenced through Fc modifications by techniques known to those skilled in the art. For example, Fc effector functions such as C1q binding, complement dependent cytotoxicity (CDC), antibody-dependent cell-mediated cytotoxicity (ADCC), antibody-dependent cell-mediated phagocytosis (ADCP), down regulation of cell surface receptors (e.g., B cell receptor; BCR), etc. can be provided and/or controlled by modifying residues in the Fc responsible for these activities.

"Antibody-dependent cell-mediated cytotoxicity" or "ADCC" refers to a cell-mediated reaction in which nonspecific cytotoxic cells that express Fc receptors (FcRs) (e.g. Natural Killer (NK) cells, neutrophils, and macrophages) recognize bound antibody on a target cell and subsequently cause lysis of the target cell.

The ability of antibodies to induce ADCC can be enhanced by engineering their oligosaccharide component. Human IgG1 or IgG3 are N-glycosylated at Asn297 with the majority of the glycans in the well-known biantennary G0, G0F, G1, G1F, G2 or G2F forms. Antibodies produced by non-engineered CHO cells typically have a glycan fucose content of about at least 85%. The removal of the core fucose from the biantennary complex-type oligosaccharides attached to the Fc regions enhances the ADCC of antibodies via improved FcγRIIIa binding without altering antigen binding or CDC activity. Such Abs can be achieved using different methods reported to lead to the successful expression of relatively high defucosylated antibodies bearing the biantennary complex-type of Fc oligosaccharides such as control of culture osmolality (Konno et al., Cytotechnology 64:249-65, 2012), application of a variant CHO line Lec13 as the host cell line (Shields et al., J Biol Chem 277:26733-26740, 2002), application of a variant CHO line EB66 as the host cell line (Olivier et al., MAbs; 2(4), 2010; Epub ahead of print; PMID:20562582), application of a rat hybridoma cell line YB2/0 as the host cell line (Shinkawa et al., J Biol Chem 278:3466-3473, 2003), introduction of small interfering RNA specifically against the α-1,6-fucosyltrasferase (FUT8) gene (Mori et al., Biotechnol Bioeng 88:901-908, 2004), or coexpression of β-1,4-N-acetylglucosaminyltransferase III and golgi α-mannosidase II or a potent alpha-mannosidase I inhibitor, kifunensine (Ferrara et al., J Biol Chem 281:5032-5036, 2006, Ferrara et al., Biotechnol Bioeng 93:851-861, 2006; Xhou et al., Biotechnol Bioeng 99:652-65, 2008).

In some embodiments described herein, ADCC elicited by the anti-Vβ17 bispecific antibodies provided herein can also be enhanced by certain substitutions in the antibody Fc. Exemplary substitutions are for example substitutions at amino acid positions 256, 290, 298, 312, 356, 330, 333, 334, 360, 378 or 430 (residue numbering according to the EU index) as described in U.S. Pat. No. 6,737,056.

According to another particular aspect, the invention relates to an isolated anti-Vβ17 bispecific antibody or antigen-binding fragment thereof, wherein the anti-Vβ17 bispecific antibody or antigen-binding fragment thereof is chimeric.

According to another particular aspect, the invention relates to an isolated anti-Vβ17 bispecific antibody or antigen-binding fragment thereof, wherein the anti-Vβ17 bispecific antibody or antigen-binding fragment thereof is human or humanized.

According to another particular aspect, the invention relates to an isolated anti-Vβ17/anti-CD123 bispecific antibody or antigen-binding fragment thereof, wherein the anti-Vβ17/anti-CD123 bispecific antibody or antigen-binding fragment thereof is chimeric.

According to another particular aspect, the invention relates to an isolated anti-Vβ17/anti-CD123 bispecific antibody or antigen-binding fragment thereof, wherein the anti-Vβ17/anti-CD123 bispecific antibody or antigen-binding fragment thereof is human or humanized.

According to another particular aspect, the invention relates to an isolated anti-Vβ17/anti-BCMA bispecific antibody or antigen-binding fragment thereof, wherein the anti-Vβ17/anti-BCMA bispecific antibody or antigen-binding fragment thereof is chimeric.

According to another particular aspect, the invention relates to an isolated anti-Vβ17/anti-BCMA bispecific antibody or antigen-binding fragment thereof, wherein the anti-Vβ17/anti-BCMA bispecific antibody or antigen-binding fragment thereof is human or humanized.

According to another particular aspect, the invention relates to an isolated anti-Vβ17/anti-DLL3 bispecific antibody or antigen-binding fragment thereof, wherein the anti-Vβ17/anti-DLL3 bispecific antibody or antigen-binding fragment thereof is chimeric.

According to another particular aspect, the invention relates to an isolated anti-Vβ17/anti-DLL3 bispecific antibody or antigen-binding fragment thereof, wherein the anti-Vβ17/anti-DLL3 bispecific antibody or antigen-binding fragment thereof is human or humanized.

According to another particular aspect, the invention relates to an isolated anti-Vβ17/anti-PSMA bispecific antibody or antigen-binding fragment thereof, wherein the anti-Vβ17/anti-PSMA bispecific antibody or antigen-binding fragment thereof is chimeric.

According to another particular aspect, the invention relates to an isolated anti-Vβ17/anti-PSMA bispecific antibody or antigen-binding fragment thereof, wherein the anti-Vβ17/anti-PSMA bispecific antibody or antigen-binding fragment thereof is human or humanized.

According to another particular aspect, the invention relates to an isolated anti-Vβ17/anti-KLK2 bispecific antibody or antigen-binding fragment thereof, wherein the anti-Vβ17/anti-KLK2 bispecific antibody or antigen-binding fragment thereof is chimeric.

According to another particular aspect, the invention relates to an isolated anti-Vβ17/anti-KLK2 bispecific antibody or antigen-binding fragment thereof, wherein the anti-Vβ17/anti-KLK2 bispecific antibody or antigen-binding fragment thereof is human or humanized.

In another general aspect, the invention relates to an isolated humanized Vβ17 monoclonal antibody or antigen-binding fragment thereof. The isolated humanized Vβ17 monoclonal antibody or antigen-binding fragment thereof comprises an amino acid sequence with at least 85%, preferably 90%, more preferably 95% or more, such as 95%, 96%, 97%, 98%, or 99% identity to the amino acid sequence of SEQ ID NO:28. In certain embodiments, the humanized Vβ17 monoclonal antibody or antigen-binding fragment thereof comprises the amino acid sequence of SEQ ID NO:28.

In some embodiments, the first binding domain is human. In some embodiments, the second binding domain is human. In other embodiments, both the first binding domain and the second binding domain are human. In some embodiments, the first binding domain is humanized. In some embodiments, the second binding domain is humanized. In other embodiments, both the first binding domain and the second binding domain are humanized. In other embodiments, both the first binding domain is human and the second binding domain is humanized. In other embodiments, both the first binding domain is humanized and the second binding domain is human.

In some embodiments, the bispecific antibody is an IgG antibody. In some embodiments, the IgG antibody is an IgG1 antibody. In some embodiments, the IgG antibody is an IgG2 antibody. In some embodiments, the IgG antibody is an IgG3 antibody. In some embodiments, the IgG antibody is an IgG4 antibody.

In some embodiments, the bispecific antibody is multivalent. In some embodiments, the bispecific antibody is capable of binding at least three antigens. In some embodiments, the bispecific antibody is capable of binding at least five antigens.

In certain embodiments, the bispecific antibodies provided herein are part of a multispecific antibody. In some embodiments, the multispecific antibody comprises a first binding domain that binds to a Vβ17 antigen. In some embodiments, the multispecific antibody comprises a first binding domain that binds to a Vβ17 antigen and comprises a second binding domain that binds to a second target antigen, as provided herein. In certain embodiments, the multispecific antibody binds to a Vβ17 antigen, a second target antigen, and one or more additional antigens. In some embodiments of the various antibodies provided herein, the antibody binds to an epitope of a given antigen.

Also provided are isolated nucleic acids encoding the monoclonal antibodies or antigen-binding fragments thereof and the bispecific antibodies or antigen-binding fragments thereof disclosed herein. Also provided are vectors comprising the isolated nucleic acids encoding the monoclonal antibodies or antigen-binding fragments thereof and the bispecific antibodies or antigen-binding fragments thereof disclosed herein. Also provided are host cells comprising the vectors comprising the isolated nucleic acids disclosed herein.

In certain aspects, provided is a nucleic acid encoding an antibody that binds to a Vβ17 provided herein. Also provided is a vector comprising a nucleic acid encoding an antibody that binds to a Vβ17 provided herein. Also provided is a host cell comprising a vector comprising a nucleic acid encoding an antibody that binds to a Vβ17 provided herein. Also provided is a kit comprising the vector comprising a nucleic acid encoding an antibody that binds to a Vβ17 provided herein, and packaging for the same.

Also provided is a nucleic acid encoding a bispecific antibody comprising: (a) a first binding domain that binds to Vβ17, and (b) a second binding domain that binds to a second target that is not Vβ17, as provided herein. Also provided is a vector comprising a nucleic acid encoding a bispecific antibody that binds to a Vβ17 provided herein. Also provided is a host cell comprising a vector comprising a nucleic acid encoding a bispecific antibody that binds to a Vβ17 provided herein. Also provided is a kit comprising the vector comprising a nucleic acid encoding a bispecific antibody that binds to a Vβ17 provided herein, and packaging for the same. In another general aspect, the invention relates to an isolated nucleic acid encoding a monoclonal antibody or antigen-binding fragment thereof disclosed herein. In another general aspect, the invention relates to an isolated nucleic acid encoding a bispecific antibody or antigen-binding fragment thereof disclosed herein. It will be appreciated by those skilled in the art that the coding sequence of a protein can be changed (e.g., replaced, deleted, inserted, etc.) without changing the amino acid sequence of the protein. Accordingly, it will be understood by those skilled in the art that nucleic acid sequences encoding monoclonal antibodies and/or bispecific antibodies provided herein can be altered without changing the amino acid sequences of the proteins.

In another general aspect, the invention relates to a vector comprising an isolated nucleic acid encoding a monoclonal antibody or antigen-binding fragment thereof disclosed herein. In another general aspect, the invention relates to a vector comprising an isolated nucleic acid encoding a bispecific antibody or antigen-binding fragment thereof disclosed herein. Any vector known to those skilled in the art in view of the present disclosure can be used, such as a plasmid, a cosmid, a phage vector or a viral vector. In some embodiments, the vector is a recombinant expression vector such as a plasmid. The vector can include any element to establish a conventional function of an expression vector, for example, a promoter, ribosome binding element, terminator, enhancer, selection marker, and origin of replication. The promoter can be a constitutive, inducible or repressible promoter. A number of expression vectors capable of delivering nucleic acids to a cell are known in the art and can be used herein for production of an antibody or antigen-binding fragment thereof in the cell. Conventional cloning techniques or artificial gene synthesis can be used to generate a recombinant expression vector according to embodiments provided herein. Such techniques are well known to those skilled in the art in view of the present disclosure.

In another general aspect, the invention relates to a host cell comprising an isolated nucleic acid encoding a monoclonal antibody and/or bispecific antibody or an antigen-binding fragment thereof provided herein. Any host cell known to those skilled in the art in view of the present disclosure can be used for recombinant expression of antibodies or antigen-binding fragments thereof provided herein. In some embodiments, the host cells are *E. coli* TG1 or BL21 cells (for expression of, e.g., an scFv or Fab antibody), CHO-DG44 or CHO-K1 cells or HEK293 cells (for expression of, e.g., a full-length IgG antibody). According to particular embodiments, the recombinant expression vector is transformed into host cells by conventional methods such as chemical transfection, heat shock, or electroporation, where it is stably integrated into the host cell genome such that the recombinant nucleic acid is effectively expressed.

In another general aspect, the invention relates to a method of producing a bispecific antibody or antigen-binding fragment thereof disclosed herein. The methods comprise culturing a cell comprising a nucleic acid encoding the bispecific antibody or antigen-binding fragment thereof under conditions to produce a bispecific antibody or antigen-binding fragment thereof disclosed herein and recovering the antibody or antigen-binding fragment thereof from the cell or cell culture (e.g., from the supernatant). Expressed antibodies or antigen-binding fragments thereof can be harvested from the cells and purified according to conventional techniques known in the art and as described herein.

In another general aspect, provided is a method of producing a bispecific antibody or antigen-binding fragment thereof disclosed herein. The methods comprise culturing a cell comprising a nucleic acid encoding the bispecific antibody or antigen-binding fragment thereof under conditions to produce a bispecific antibody or antigen-binding fragment thereof disclosed herein and recovering the antibody or antigen-binding fragment thereof from the cell or cell culture (e.g., from the supernatant). Expressed antibodies or antigen-binding fragments thereof can be harvested from the cells and purified according to conventional techniques known in the art and as described herein.

Also provided are methods of producing the bispecific antibodies or antigen-binding fragments thereof disclosed herein. The methods can comprise culturing a cell comprising a nucleic acid encoding one heavy and light chain pair of the bispecific antibody under conditions to produce the heavy and light chains or an antigen-binding fragment thereof, and recovering the heavy and light chains of the bispecific antibody or an antigen-binding fragment thereof from the cell or culture. Following collection of heavy and light chains for both arms of the bispecific antibody, the heavy and light chain pairs are mixed in conditions suitable to allow for self-assembly, after which the self-assembled bispecific antibodies are collected.

Pharmaceutical Compositions

In another general aspect, the invention relates to a pharmaceutical composition comprising an isolated bispecific antibody or antigen-binding fragment thereof provided herein and a pharmaceutically acceptable carrier. Also provided is a pharmaceutical composition comprising an antibody that binds to a Vβ17 provided herein, and a pharmaceutically acceptable carrier. Also provided is a method of producing the pharmaceutical composition, comprising combining the antibody with a pharmaceutically acceptable carrier to obtain the pharmaceutical composition. In another aspect, provided herein is a pharmaceutical composition comprising a comprising: (a) a first binding domain that binds to Vβ17, and (b) a second binding domain that binds to a second target that is not Vβ17, and a pharmaceutically acceptable carrier. Any of the bispecific antibodies provided herein are contemplated in the pharmaceutical compositions. In certain embodiments, the second binding domain binds to CD123. In certain embodiments, the second binding domain binds to BCMA. In certain embodiments, the second binding domain binds to DLL3. In certain embodiments, the second binding domain binds to PSMA. In certain embodiments, the second binding domain binds to KLK2. The term "pharmaceutical composition" as used herein means a product comprising an antibody provided herein together with a pharmaceutically acceptable carrier. Antibodies provided herein and compositions comprising them are also useful in the manufacture of a medicament for therapeutic applications mentioned herein.

Also provided are methods of producing compositions comprising the bispecific antibodies or antigen-binding fragments disclosed herein, such as buffered compositions or purified compositions and the like. For example, the methods may comprise combining the bispecific antibody or antigen-binding fragment thereof with a buffer acceptable that is acceptable for storage and use of the bispecific antibody.

As used herein, the term "carrier" refers to any excipient, diluent, filler, salt, buffer, stabilizer, solubilizer, oil, lipid, lipid containing vesicle, microsphere, liposomal encapsulation, or other material well known in the art for use in pharmaceutical formulations. It will be understood that the characteristics of the carrier, excipient or diluent will depend on the route of administration for a particular application. As used herein, the term "pharmaceutically acceptable carrier" refers to a non-toxic material that does not interfere with the effectiveness of a composition according to the invention or the biological activity of a composition provided herein. According to particular embodiments, in view of the present disclosure, any pharmaceutically acceptable carrier suitable for use in an antibody pharmaceutical composition can be used herein.

The formulation of pharmaceutically active ingredients with pharmaceutically acceptable carriers is known in the art, e.g., Remington: The Science and Practice of Pharmacy (e.g. 21st edition (2005), and any later editions). Non-limiting examples of additional ingredients include: buffers, diluents, solvents, tonicity regulating agents, preservatives, stabilizers, and chelating agents. One or more pharmaceutically acceptable carriers can be used in formulating the pharmaceutical compositions provided herein.

In one embodiment of the invention, the pharmaceutical composition is a liquid formulation. A preferred example of a liquid formulation is an aqueous formulation, i.e., a formulation comprising water. The liquid formulation can comprise a solution, a suspension, an emulsion, a microemulsion, a gel, and the like. An aqueous formulation typically comprises at least 50% w/w water, or at least 60%, 70%, 75%, 80%, 85%, 90%, or at least 95% w/w of water.

In one embodiment, the pharmaceutical composition can be formulated as an injectable which can be injected, for example, via an injection device (e.g., a syringe or an infusion pump). The injection can be delivered subcutaneously, intramuscularly, intraperitoneally, intravitreally, or intravenously, for example.

In another embodiment, the pharmaceutical composition is a solid formulation, e.g., a freeze-dried or spray-dried composition, which can be used as is, or whereto the physician or the patient adds solvents, and/or diluents prior to use. Solid dosage forms can include tablets, such as compressed tablets, and/or coated tablets, and capsules (e.g., hard or soft gelatin capsules). The pharmaceutical composition can also be in the form of sachets, dragees, powders, granules, lozenges, or powders for reconstitution, for example.

The dosage forms can be immediate release, in which case they can comprise a water-soluble or dispersible carrier, or they can be delayed release, sustained release, or modified release, in which case they can comprise water-insoluble polymers that regulate the rate of dissolution of the dosage form in the gastrointestinal tract or under the skin.

In other embodiments, the pharmaceutical composition can be delivered intranasally, intrabuccally, or sublingually.

The pH in an aqueous formulation can be between pH 3 and pH 10. In one embodiment provided herein, the pH of the formulation is from about 7.0 to about 9.5. In another embodiment provided herein, the pH of the formulation is from about 3.0 to about 7.0.

In another embodiment provided herein, the pharmaceutical composition comprises a buffer. Non-limiting examples of buffers include: arginine, aspartic acid, bicine, citrate, disodium hydrogen phosphate, fumaric acid, glycine, glycylglycine, histidine, lysine, maleic acid, malic acid, sodium acetate, sodium carbonate, sodium dihydrogen phosphate, sodium phosphate, succinate, tartaric acid, tricine, and tris(hydroxymethyl)-aminomethane, and mixtures thereof. The buffer can be present individually or in the aggregate, in a concentration from about 0.01 mg/ml to about 50 mg/ml, for example from about 0.1 mg/ml to about 20 mg/ml. Pharmaceutical compositions comprising each one of these specific buffers constitute alternative embodiments provided herein.

In another embodiment provided herein, the pharmaceutical composition comprises a preservative. Non-limiting examples of preservatives include: benzethonium chloride, benzoic acid, benzyl alcohol, bronopol, butyl 4-hydroxybenzoate, chlorobutanol, chlorocresol, chlorhexidine, chlorphenesin, o-cresol, m-cresol, p-cresol, ethyl 4-hydroxybenzoate, imidurea, methyl 4-hydroxybenzoate, phenol, 2-phenoxyethanol, 2-phenylethanol, propyl 4-hydroxybenzoate, sodium dehydroacetate, thiomerosal, and mixtures thereof. The preservative can be present individually or in the aggregate, in a concentration from about 0.01 mg/ml to about 50 mg/ml, for example from about 0.1 mg/ml to about 20 mg/ml. Pharmaceutical compositions comprising each one of these specific preservatives constitute alternative embodiments provided herein.

In another embodiment provided herein, the pharmaceutical composition comprises an isotonic agent. Non-limiting examples of isotonic agents include a salt (such as sodium chloride), an amino acid (such as glycine, histidine, arginine, lysine, isoleucine, aspartic acid, tryptophan, and threonine), an alditol (such as glycerol, 1,2-propanediol propylenegly-col), 1,3-propanediol, and 1,3-butanediol), polyethyleneglycol (e.g. PEG400), and mixtures thereof. Another example of an isotonic agent includes a sugar. Non-limiting examples of sugars can include mono-, di-, or polysaccharides, or water-soluble glucans, including for example fructose, glucose, mannose, sorbose, xylose, maltose, lactose, sucrose, trehalose, dextran, pullulan, dextrin, cyclodextrin, alpha and beta-HPCD, soluble starch, hydroxyethyl starch, and sodium carboxymethyl-cellulose. Another example of an isotonic agent is a sugar alcohol, wherein the term "sugar alcohol" is defined as a C(4-8) hydrocarbon having at least one —OH group. Non-limiting examples of sugar alcohols include mannitol, sorbitol, inositol, galactitol, dulcitol, xylitol, and arabitol. The isotonic agent can be present individually or in the aggregate, in a concentration from about 0.01 mg/ml to about 50 mg/ml, for example from about 0.1 mg/ml to about 20 mg/ml. Pharmaceutical compositions comprising each one of these specific isotonic agents constitute alternative provided herein.

In another embodiment provided herein, the pharmaceutical composition comprises a chelating agent. Non-limiting examples of chelating agents include citric acid, aspartic acid, salts of ethylenediaminetetraacetic acid (EDTA), and mixtures thereof. The chelating agent can be present individually or in the aggregate, in a concentration from about 0.01 mg/ml to about 50 mg/ml, for example from about 0.1 mg/ml to about 20 mg/ml. Pharmaceutical compositions comprising each one of these specific chelating agents constitute alternative embodiments of the invention.

In another embodiment provided herein, the pharmaceutical composition comprises a stabilizer. Non-limiting examples of stabilizers include one or more aggregation inhibitors, one or more oxidation inhibitors, one or more surfactants, and/or one or more protease inhibitors.

In another embodiment provided herein, the pharmaceutical composition comprises a stabilizer, wherein said stabilizer is carboxy-/hydroxycellulose and derivates thereof (such as HPC, HPC-SL, HPC-L and HPMC), cyclodextrins, 2-methylthioethanol, polyethylene glycol (such as PEG 3350), polyvinyl alcohol (PVA), polyvinyl pyrrolidone, salts (such as sodium chloride), sulphur-containing substances such as monothioglycerol), or thioglycolic acid. The stabilizer can be present individually or in the aggregate, in a concentration from about 0.01 mg/ml to about 50 mg/ml, for example from about 0.1 mg/ml to about 20 mg/ml. Pharmaceutical compositions comprising each one of these specific stabilizers constitute alternative embodiments provided herein.

In further embodiments provided herein, the pharmaceutical composition comprises one or more surfactants, preferably a surfactant, at least one surfactant, or two different surfactants. The term "surfactant" refers to any molecules or ions that are comprised of a water-soluble (hydrophilic) part, and a fat-soluble (lipophilic) part. The surfactant can, for example, be selected from the group consisting of anionic surfactants, cationic surfactants, nonionic surfactants, and/or zwitterionic surfactants. The surfactant can be present individually or in the aggregate, in a concentration from about 0.1 mg/ml to about 20 mg/ml. Pharmaceutical compositions comprising each one of these specific surfactants constitute alternative embodiments provided herein.

In a further embodiment provided herein, the pharmaceutical composition comprises one or more protease inhibitors, such as, e.g., EDTA, and/or benzamidine hydrochloric acid (HC1). The protease inhibitor can be present individually or in the aggregate, in a concentration from about 0.1 mg/ml to about 20 mg/ml. Pharmaceutical compositions comprising each one of these specific protease inhibitors constitute alternative embodiments provided herein.

In another general aspect, the invention relates to a method of producing a pharmaceutical composition comprising a bispecific antibody or antigen-binding fragment thereof disclosed herein, comprising combining a bispecific antibody or antigen-binding fragment thereof with a pharmaceutically acceptable carrier to obtain the pharmaceutical composition.

Methods of Use

In one general aspect, provided is a method of activating a T cell expressing Vβ17, comprising contacting the T cell with an antibody that binds to a Vβ17 provided herein. In another aspect, provided herein is a method of activating a T cell expressing Vβ17, comprising contacting the T cell with the bispecific antibody, as provided herein. In some embodiments, the contacting results in an increase in CD69, CD25, and/or Granzyme B expression, as compared to a control T cell expressing Vβ17.

In another general aspect, provided is a method of inactivating a T cell expressing Vβ17, comprising contacting the T cell with an antibody that binds to a Vβ17 provided herein. In another aspect, provided herein is a method of inactivating a T cell expressing Vβ17, comprising contacting the T cell with the bispecific antibody, as provided herein.

In another general aspect, provided is a method of blocking activation of a T cell expressing Vβ17, comprising contacting the T cell with an antibody that binds to a Vβ17 provided herein. In another aspect, provided herein is a method of blocking activation of a T cell expressing Vβ17, comprising contacting the T cell with the bispecific antibody, as provided herein.

In another general aspect, provided is a method of modulating the activation of a T cell expressing Vβ17, comprising contacting the T cell with an antibody that binds to a Vβ17 provided herein. In another aspect, provided herein is a method of modulating the activation of a T cell expressing Vβ17, comprising contacting the T cell with the bispecific antibody, as provided herein.

In another aspect, provided herein is a method of directing a T cell expressing Vβ17 to a target cell, the method comprising contacting the T cell with a bispecific antibody provided herein. In some embodiments, the contacting directs the T cell to the target cell.

Also provided is a method of targeting an antigen on the surface of a target cell, the method comprising exposing the target cell to an anti-Vβ17 bispecific antibody or antigen binding fragment thereof provided herein. Also provided is a method of targeting an antigen on the surface of a target cell, the method comprising exposing the target cell to a pharmaceutical composition comprising an anti-Vβ17 bispecific antibody or antigen binding fragment thereof provided herein In another general aspect, provided is a method of targeting an antigen on the surface of a target cell, the method comprising exposing the target cell to an anti-Vβ17 bispecific antibody or antigen binding fragment thereof or a pharmaceutical composition provided herein.

The functional activity of bispecific antibodies and antigen-binding fragments thereof that bind Vβ17 or a second target antigen can be characterized by methods known in the art and as described herein. Methods for characterizing antibodies and antigen-binding fragments thereof that bind Vβ17 or a second target antigen include, but are not limited to, affinity and specificity assays including Biacore, ELISA, and OctetRed analysis; binding assays to detect the binding of antibodies to target cells by FACS; binding assays to detect the binding of antibodies to Vβ17 on T cells. According to particular embodiments, the methods for characterizing antibodies and antigen-binding fragments thereof that bind Vβ17 or a second target antigen include those described below. In some embodiments, the second target is CD123. In other embodiments, the second target is BCMA. In other embodiments, the second target is DLL3. In other embodiments, the second target is PSMA. In other embodiments, the second target is KLK2.

Also provided is a method of directing Vβ17-expressing T cells to a second target. The methods can comprise contacting the Vβ17-expressing T cell with an anti-Vβ17 bispecific antibody or antigen binding fragment thereof provided herein, wherein the anti-Vβ17 bispecific antibody or antigen binding fragment thereof directs the Vβ17-expressing T cell to the second target. Also provided is a method of directing a T cell expressing Vβ17 to a second target, the method comprising contacting the T cell with a bispecific antibody provided herein, wherein the contacting directs the T cell to the second target.

Also provided is a method for inhibiting growth or proliferation of target cells. The methods can comprise contacting the Vβ17-expressing T cells with an anti-Vβ17 bispecific antibody or antigen binding fragment thereof provided herein, wherein contacting the target cells with the anti-Vβ17 bispecific antibody or antigen binding fragment thereof composition inhibits the growth or proliferation of the target cells. Also provided is a method of inhibiting growth or proliferation of target cells expressing a second target antigen on the cell surface, the method comprising contacting the target cells with a bispecific antibody provided herein, wherein contacting the target cells with the pharmaceutical composition inhibits growth or proliferation of the target cells. Also provided is a method of inhibiting growth or proliferation of target cells expressing a second target antigen on the cell surface, the method comprising contacting the target cells with a bispecific antibody provided herein, wherein contacting the target cells with the antibody or the bispecific antibody inhibits growth or proliferation of the target cells. In some embodiments, the target cells are in the presence of a T cell expressing Vβ17 while in contact with the bispecific antibody.

In another aspect, provided herein is a method for eliminating target cells in a subject, comprising administering an effective amount of a bispecific antibody, as provided herein, to the subject. In another general aspect, the invention relates to a method of treating a disease or disorder in a subject in need thereof, comprising administering to the subject an isolated bispecific antibody or antigen binding fragment thereof that specifically binds Vβ17 and a second target antigen presented on the surface of a target cell, or a pharmaceutical composition disclosed herein. In some embodiments, provided is a method for eliminating target cells expressing the second antigen or treating a disease caused all or in part by target cells expressing the second antigen in a subject, comprising administering an effective amount of a bispecific antibody provided herein to the subject. In some embodiments, the subject is a subject in need thereof. In some embodiments, the subject is a human.

Also provided are methods of directing a Vβ17-expressing CD8+ or CD4+ T cell to a cancer cell. The methods comprise contacting a Vβ17-expressing CD8+ or CD4+ T cell with an anti-Vβ17/anti-CD123 bispecific antibodies or antigen-binding fragments thereof disclosed herein. Contacting the Vβ17-expressing CD8+ or CD4+ T cell with the anti-Vβ17/anti-CD123 bispecific antibodies or antigen-binding fragments thereof can direct the Vβ17-expressing CD8+ or CD4+ T cell to a cancer cell. Also provided are methods for inhibiting growth or proliferation of cancer cells. The methods comprise contacting the cancer cells with the bispecific antibodies disclosed herein. Contacting the cancer cells with the described antibodies can, for example, inhibit the growth or proliferation of the cancer cells, or promote T cell mediated killing of the cancer cells.

In another aspect, provided herein is a method of directing a T cell expressing Vβ17 to a target cell, the method comprising contacting the T cell with a bispecific antibody provided herein. In some embodiments, the contacting directs the T cell to the target cell. In certain embodiments, the target cell is a cancer cell.

Also provided is a method of targeting an antigen on the surface of a cancer cell, the method comprising exposing the cancer cell to an anti-Vβ17 bispecific antibody or antigen binding fragment thereof provided herein. Also provided is a method of targeting an antigen on the surface of a cancer cell, the method comprising exposing the cancer cell to a pharmaceutical composition comprising an anti-Vβ17 bispecific antibody or antigen binding fragment thereof provided herein In another general aspect, provided is a method of targeting a target antigen on the surface of a target cell, the method comprising exposing the target cell to an anti-Vβ17 bispecific antibody or antigen binding fragment thereof or a pharmaceutical composition provided herein. In another general aspect, provided is a method of targeting a cancer antigen on the surface of a cancer cell, the method comprising exposing the cancer cell to an anti-Vβ17 bispecific antibody or antigen binding fragment thereof or a pharmaceutical composition provided herein.

The functional activity of bispecific antibodies and antigen-binding fragments thereof that bind Vβ17 or cancer antigen can be characterized by methods known in the art and as described herein. Methods for characterizing antibodies and antigen-binding fragments thereof that bind Vβ17 or a cancer antigen include, but are not limited to, affinity and specificity assays including Biacore, ELISA, and OctetRed analysis; binding assays to detect the binding of antibodies to cancer by FACS; binding assays to detect the binding of antibodies to Vβ17 on T cells. According to particular embodiments, the methods for characterizing antibodies and antigen-binding fragments thereof that bind Vβ17 and/or a cancer antigen include those described below.

Also provided is a method of directing Vβ17-expressing T cells to a cancer cell. The methods can comprise contacting the Vβ17-expressing T cell with an anti-Vβ17 bispecific antibody or antigen binding fragment thereof provided herein, wherein the anti-Vβ17 bispecific antibody or antigen binding fragment thereof directs the Vβ17-expressing T cell to the cancer. Also provided is a method of directing a T cell expressing Vβ17 to a cancer cell, the method comprising contacting the T cell with a bispecific antibody provided herein, wherein the contacting directs the T cell to the cancer cell.

Also provided is a method for inhibiting growth or proliferation of cancer cells. The methods can comprise contacting the Vβ17-expressing T cells with an anti-Vβ17 bispecific antibody or antigen binding fragment thereof provided herein, wherein contacting the cancer cells with the anti-Vβ17 bispecific antibody or antigen binding fragment thereof composition inhibits the growth or proliferation of the cancer cells. Also provided is a method of inhibiting growth or proliferation of cancer cells expressing a cancer antigen on the cell surface, the method comprising contacting the cancer cells with a bispecific antibody provided herein, wherein contacting the cancer cells with the pharmaceutical composition inhibits growth or proliferation of the cancer cells. Also provided is a method of inhibiting growth or proliferation of cancer cells expressing a cancer antigen on the cell surface, the method comprising contacting the cancer cells with a bispecific antibody provided herein, wherein contacting the cancer cells with the antibody or the bispecific antibody inhibits growth or proliferation of the cancer cells. In some embodiments, the cancer cells are in the presence of a T cell expressing Vβ17 while in contact with the bispecific antibody.

In another aspect, provided herein is a method for eliminating target cells in a subject, comprising administering an effective amount of a bispecific antibody, as provided herein, to the subject. In another general aspect, the invention relates to a method of treating a cancer in a subject in need thereof, comprising administering to the subject an isolated bispecific antibody or antigen binding fragment thereof that specifically binds Vβ17 and a cancer antigen presented on the surface of a cancer cell, or a pharmaceutical composition disclosed herein. In some embodiments, provided is a method for eliminating cancer cells expressing the cancer antigen in a subject, comprising administering an effective amount of a bispecific antibody provided herein to the subject. In some embodiments, provided is a method for treating a disease caused all or in part by cancer cells expressing the cancer antigen in a subject, comprising administering an effective amount of a bispecific antibody provided herein to the subject. In some embodiments, the subject is a subject in need thereof. In some embodiments, the subject is a human. In some embodiments, the disease is cancer. In specific embodiments, the bispecific antibody binds Vβ17 and a cancer antigen.

In some embodiments, the antigen on the surface of the cancer cell is a tumor-specific antigen, a tumor-associated antigen, or a neoantigen.

In some embodiments, the cancer cell is a cell of an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer. In some embodiments, the adrenal cancer is an adrenocortical carcinoma (ACC), adrenal cortex cancer, pheochromocytoma, or neuroblastoma. In some embodiments, the anal cancer is a squamous cell carcinoma, cloacogenic carcinoma, adenocarcinoma, basal cell carcinoma, or melanoma. In some embodiments, the appendix cancer is a neuroendocrine tumor (NET), mucinous adenocarcinoma, goblet cell carcinoid, intestinal-type adenocarcinoma, or signet-ring cell adenocarcinoma. In some embodiments, the bile duct cancer is an extrahepatic bile duct cancer, adenocarcinomas, hilar bile duct cancer, perihilar bile duct cancer, distal bile duct cancer, or intrahepatic bile duct cancer. In some embodiments, the bladder cancer is transitional cell carcinoma (TCC), papillary carcinoma, flat carcinoma, squamous cell carcinoma, adenocarcinoma, small-cell carcinoma, or sarcoma. In some embodiments, the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer. In some embodiments, the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma. In some embodiments, the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer. In some embodiments, the cervical cancer is a squamous cell carcinoma, or adenocarcinoma. In some embodiments, the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma. In some embodiments, the esophageal cancer is an adenocarcinoma or squamous cell carcinoma. In some embodiments, the gall bladder cancer is an adenocarcinoma, papillary adenocarcinoma, adenosquamous carcinoma, squamous cell carcinoma, small cell carcinoma, or sarcoma. In some embodiments, the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT). In some embodiments, the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer. In some embodiments, the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL). In some embodiments, the intestinal cancer is a small intestine cancer, small bowel cancer, adenocarcinoma, sarcoma, gastrointestinal stromal tumors, carcinoid tumors, or lymphoma. In some embodiments, the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma. In some embodiments, the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS). In some embodiments, the liver cancer is a hepatocellular carcinoma (HCC), fibrolamellar HCC, cholangiocarcinoma, angiosarcoma, or liver metastasis. In some embodiments, the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor. In some embodiments, the melanoma is a superficial spreading melanoma, nodular melanoma, acral-lentiginous melanoma, lentigo maligna melanoma, amelanotic melanoma, desmoplastic melanoma, ocular melanoma, or metastatic melanoma. In some embodiments, the mesothelioma is a pleural mesothelioma, peritoneal mesothelioma, pericardial mesothelioma, or testicular mesothelioma. In some embodiments, the multiple myeloma is an active myeloma or smoldering myeloma. In some embodiments, the neuroendocrine tumor, is a gastrointestinal neuroendocrine tumor, pancreatic neuroendocrine tumor, or lung neuroendocrine tumor. In some embodiments, the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma. In some embodiments, the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma acuminatum, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer. In some embodiments, the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst. In some embodiments, the pancreatic cancer is a pancreatic exocrine gland cancer, pancreatic endocrine gland cancer, or pancreatic adenocarcinoma, islet cell tumor, or neuroendocrine tumor. In some embodiments, the prostate cancer is a prostate adenocarcinoma, prostate sarcoma, transitional cell carcinoma, small cell carcinoma, or neuroendocrine tumor. In some embodiments, the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer. In some embodiments, the skin cancer is a basal cell carcinoma, squamous cell carcinoma, melanoma, Merkel cell carcinoma, Kaposi sarcoma (KS), actinic keratosis, skin lymphoma, or keratoacanthoma. In some embodiments, the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma. In some embodiments, the spinal cancer is a spinal metastatic tumor. In some embodiments, the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid. In some embodiments, the testicular cancer is a seminoma, non-seminoma, embryonal carcinoma, yolk sac carcinoma, choriocarcinoma, teratoma, gonadal stromal tumor, leydig cell tumor, or sertoli cell tumor. In some embodiments, the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer. In some embodiments, the thyroid cancer is a papillary carcinoma, follicular carcinoma, Hürthle cell carcinoma, medullary thyroid carcinoma, or anaplastic carcinoma. In some embodiments, the uterine cancer is an endometrial cancer, endometrial adenocarcinoma, endometroid carcinoma, serous adenocarcinoma, adenosquamous carcinoma, uterine carcinosarcoma, uterine sarcoma, uterine leiomyosarcoma, endometrial stromal sarcoma, or undifferentiated sarcoma. In some embodiments, the vaginal cancer is a squamous cell carcinoma, adenocarcinoma, melanoma, or sarcoma. In some embodiments, the vulvar cancer is a squamous cell carcinoma or adenocarcinoma. In some embodiments, the cancer antigen is angiopoietin, BCMA, CD19, CD20, CD22, CD25 (IL2-R), CD30, CD33, CD37, CD38, CD52, CD56, CD123 (IL-3R), cMET, DLL/Notch, EGFR, EpCAM, FGF, FGF-R, GD2, HER2, Mesothelin, Nectin-4, PDGFRα, RANKL, SLAMF7, TROP2, VEGF, or VEGF-R. In some embodiments, the cancer antigen is CEA, immature laminin receptor, TAG-72, HPV E6, HPV E7, BING-4, calcium-activated chloride channel 2, cyclin-B1, 9D7, EpCAM, EphA3, Her2/neu, telomerase, mesothelin, SAP-1, surviving, a BAGE family antigen, CAGE family antigen, GAGE family antigen, MAGE family antigen, SAGE family antigen, XAGE family antigen, NY-ESO-1/LAGE-1, PRAME, SSX-2, Melan-A, MART-1, Gp100, pmel17, tyrosinase, TRP-1, TRP-2, P. polypeptide, MC1R, prostate-specific antigen, β-catenin, BRCA1, BRCA2, CDK4, CML66, fibronectin, MART-2, p53, Ras, TGF-βRII, or MUC1. In some embodiments, the cancer antigen is CD123. In some embodiments, the cancer antigen is BCMA. In some embodiments, the cancer antigen is DLL3. In some embodiments, the cancer antigen is PSMA. In some embodiments, the cancer antigen is KLK2.

In another aspect, provided herein is a method of inhibiting growth or proliferation of cancer cells expressing a cancer antigen on the cell surface, the method comprising contacting the cancer cells with a bispecific antibody provided herein. In some embodiments, contacting the cancer cells with the pharmaceutical composition inhibits growth or proliferation of the cancer cells. In some embodiments, contacting the cancer cells with the antibody or the bispecific antibody inhibits growth or proliferation of the cancer cells. In some embodiments, the cancer cells are in the presence of a T cell expressing Vβ17 while in contact with the bispecific antibody.

In another aspect, provided herein is a method for eliminating cancer cells in a subject, comprising administering an effective amount of a bispecific antibody, as provided herein, to the subject. In another general aspect, the invention relates to a method of treating a cancer in a subject in need thereof, comprising administering to the subject an isolated bispecific antibody or antigen binding fragment thereof that specifically binds Vβ17 and a tumor-associated antigen presented on the surface of a tumor cell (e.g., CD123) or a pharmaceutical composition disclosed herein. The cancer can, for example, be a CD123-expressing cancer. The cancer can, for example, be a CD123-expressing cancer. The cancer can, for example, be a hematologic cancer. The hematologic cancer can, for example, be a leukemia, a lymphoma, and a myeloma. The leukemia can be an acute myeloid leukemia (AML) or an acute lymphocytic leukemia (ALL).

In another aspect, provided herein is a method of directing a T cell expressing Vβ17 to a target cell, the method comprising contacting the T cell with a bispecific antibody provided herein. In some embodiments, the contacting directs the T cell to the target cell.

Also provided is a method of targeting an antigen on the surface of a B cell, the method comprising exposing the B cell to an anti-Vβ17 bispecific antibody or antigen binding fragment thereof provided herein. Also provided is a method of targeting an antigen on the surface of a B cell, the method comprising exposing the B cell to a pharmaceutical composition comprising an anti-Vβ17 bispecific antibody or antigen binding fragment thereof provided herein In another general aspect, provided is a method of targeting a target antigen on the surface of a B cell, the method comprising exposing the B cell to an anti-Vβ17 bispecific antibody or antigen binding fragment thereof or a pharmaceutical composition provided herein.

The functional activity of bispecific antibodies and antigen-binding fragments thereof that bind Vβ17 or B cell antigen can be characterized by methods known in the art and as described herein. Methods for characterizing antibodies and antigen-binding fragments thereof that bind Vβ17 or a B cell antigen include, but are not limited to, affinity and specificity assays including Biacore, ELISA, and OctetRed analysis; binding assays to detect the binding of antibodies to B cell by FACS; binding assays to detect the binding of antibodies to Vβ17 on T cells. According to particular embodiments, the methods for characterizing antibodies and antigen-binding fragments thereof that bind Vβ17 or a B cell antigen include those described below.

Also provided is a method of directing Vβ17-expressing T cells to a second target. The methods can comprise contacting the Vβ17-expressing T cell with an anti-Vβ17 bispecific antibody or antigen binding fragment thereof provided herein, wherein the anti-Vβ17 bispecific antibody or antigen binding fragment thereof directs the Vβ17-expressing T cell to the B cell. Also provided is a method of directing a T cell expressing Vβ17 to a B cell, the method comprising contacting the T cell with a bispecific antibody provided herein, wherein the contacting directs the T cell to the B cell.

Also provided is a method for inhibiting growth or proliferation of B cells. The methods can comprise contacting the Vβ17-expressing T cells with an anti-Vβ17 bispecific antibody or antigen binding fragment thereof provided herein, wherein contacting the B cells with the anti-Vβ17 bispecific antibody or antigen binding fragment thereof composition inhibits the growth or proliferation of the B cells. Also provided is a method of inhibiting growth or proliferation of B cells expressing a B cell antigen on the cell surface, the method comprising contacting the B cells with a bispecific antibody provided herein, wherein contacting the B cells with the pharmaceutical composition inhibits growth or proliferation of the B cells. Also provided is a method of inhibiting growth or proliferation of B cells expressing a B cell antigen on the cell surface, the method comprising contacting the B cells with a bispecific antibody provided herein, wherein contacting the B cells with the bispecific antibody (or the antibody) inhibits growth or proliferation of the B cells. In some embodiments, the B cells are in the presence of a T cell expressing Vβ17 while in contact with the bispecific antibody.

In another aspect, provided herein is a method for eliminating target cells in a subject, comprising administering an effective amount of a bispecific antibody, as provided herein, to the subject. In another general aspect, the invention relates to a method of treating a disease or disorder in a subject in need thereof, comprising administering to the subject an isolated bispecific antibody or antigen binding fragment thereof that specifically binds Vβ17 and a B cell antigen presented on the surface of a B cell, or a pharmaceutical composition disclosed herein. In some embodiments, provided is a method for eliminating B cells expressing the B cell antigen in a subject, comprising administering an effective amount of a bispecific antibody provided herein to the subject. In some embodiments, provided is a method for treating a disease caused all or in part by B cells expressing the B cell antigen in a subject, comprising administering an effective amount of a bispecific antibody provided herein to the subject. In some embodiments, the subject is a subject in need thereof. In some embodiments, the subject is a human. In specific embodiments, the bispecific antibody binds Vβ17 and a B cell antigen.

In some embodiments of the various methods provided herein, the B cell antigen is a CD1a, CD1b, CD1c, CD1d, CD2, CD5, CD6, CD9, CD11a, CD11b, CD11c, CD17, CD18, CD19, CD20, CD21, CD22, CD23, CD24, CD25, CD26, CD27, CD29, CD30, CD31, CD32a, CD32b, CD35, CD37, CD38, CD39, CD40, CD45, CD45RA, CD45RB, CD45RC, CD45RO, CD46, CD47, CD48, CD49b, CD49c, CD49d, CD50, CD52, CD53, CD54, CD55, CD58, CD60a, CD62L, CD63, CD68, CD69, CD70, CD72, CD73, CD74, CD75, CD75S, CD77, CD79a, CD79b, CD80, CD81, CD82, CD83, CD84, CD85E, CD85I, CD85J, CD86, CD92, CD95, CD97, CD98, CD99, CD100, CD102, CD108, CD119, CD120a, CD120b, CD121b, CD122, CD124, CD125, CD126, CD130, CD132, CD137, CD138, CD139, CD147, CD148, CD150, CD152, CD162, CD164, CD166, CD167a, CD170, CD171, CD175, CD175s, CD180, CD184, CD185, CD192, CD196, CD197, CD200, CD205, CD201a, CDw210b, CD212, CD213a1, CD213a2, CD215, CD217, CD218a, CD218b, CD220, CD221, CD222, CD224, CD225, CD226, CD227, CD229, CD230, CD232, CD252, CD252, CD254, CD255, CD256, CD257 CD258, CD259, CD260, CD261, CD262, CD263, CD264, CD267, CD268, CD269, CD270, CD272, CD274, CD275, CD277, CD279, CD283, CD289, CD290, CD295, CD298, CD300, CD300c, CD305, CD306, CD307a, CD307b, CD307c, CD307d, CD307e, CD314, CD215, CD316, CD317, CD319, CD321, CD327, CD328, CD329, CD338, CD351, CD352, CD353, CD354, CD355, CD356, CD357, CD358, CD360, CD361, CD362, or CD363 antigen.

Also provided is a method of activating a T cell expressing Vβ17, comprising contacting the T cell with an anti-Vβ17 bispecific antibody provided herein. In some embodiments, the contacting results in an increase in CD69, CD25, and/or Granzyme B expression, as compared to a control T cell expressing Vβ17. In some embodiments, a control T cell is a comparable T cell expressing Vβ17. In some embodiments, the comparable T cell (e.g., control T cell) is not contacted with the bispecific antibody.

According to embodiments provided herein, the pharmaceutical composition comprises an effective amount of an anti-Vβ17 bispecific antibody or antigen-binding fragment thereof provided herein.

In another general aspect, the invention relates to a method of targeting CD123 on the surface of a cancer cell, the method comprising exposing the cancer cell to an anti-Vβ17/anti-CD123 bispecific antibody or antigen-binding fragment thereof.

In another general aspect, the invention relates to a method of targeting BCMA on the surface of a target cell, the method comprising exposing the target cell to an anti-Vβ17/anti-BCMA bispecific antibody or antigen-binding fragment thereof.

In another general aspect, the invention relates to a method of targeting DLL3 on the surface of a target cell, the method comprising exposing the target cell to an anti-Vβ17/anti-DLL3 bispecific antibody or antigen-binding fragment thereof.

In another general aspect, the invention relates to a method of targeting PSMA on the surface of a target cell, the method comprising exposing the target cell to an anti-Vβ17/anti-PSMA bispecific antibody or antigen-binding fragment thereof.

In another general aspect, the invention relates to a method of targeting KLK2 on the surface of a target cell, the method comprising exposing the target cell to an anti-Vβ17/anti-KLK2 bispecific antibody or antigen-binding fragment thereof.

In another aspect, provides is an antibody that binds to Vβ17 as provided herein for use in a therapy. In one embodiment, the antibody is a multispecific Vβ17 antibody, as provided herein. In some embodiments, the multispecific antibody is a bispecific antibody. In one embodiment, the antibody is a multispecific Vβ17/CD123 antibody. In one embodiment, the antibody is a multispecific Vβ17/BCMA antibody. In one embodiment, the antibody is a multispecific Vβ17/DLL3 antibody. In one embodiment, the antibody is a multispecific Vβ17/PSMA antibody. In one embodiment, the antibody is a multispecific Vβ17/KLK2 antibody.

In another aspect, provides is an antibody that binds to Vβ17 as provided herein for use in the treatment of cancer. In one embodiment, the antibody is a multispecific Vβ17 antibody, as provided herein. In some embodiments, the multispecific antibody is a bispecific antibody. In some embodiments, the multispecific antibody binds to a second target on a cell of the cancer. The cancer can be any one of the cancers provided herein. In one embodiment, the antibody is a multispecific Vβ17/CD123 antibody. In one embodiment, the antibody is a multispecific Vβ17/BCMA antibody. In one embodiment, the antibody is a multispecific Vβ17/DLL3 antibody. In one embodiment, the antibody is a multispecific Vβ17/PSMA antibody. In one embodiment, the antibody is a multispecific Vβ17/KLK2 antibody.

The functional activity of bispecific antibodies and antigen-binding fragments thereof that bind Vβ17 and/or CD123 can be characterized by methods known in the art and as described herein. Methods for characterizing antibodies and antigen-binding fragments thereof that bind Vβ17 and/or CD123 include, but are not limited to, affinity and specificity assays including Biacore, ELISA, and OctetRed analysis; binding assays to detect the binding of antibodies to CD123 on cancer cells by FACS; binding assays to detect the binding of antibodies to Vβ17 on CD8+ or CD4+ T cells. According to particular embodiments, the methods for characterizing antibodies and antigen-binding fragments thereof that bind Vβ17 and/or CD123 include those described below.

In another general aspect, the invention relates to a method of directing Vβ17-expressing CD8+ or CD4+ T cells to a cancer cell. The methods comprise contacting the Vβ17-expressing CD8+ or CD4+ T cell with an anti-Vβ17/anti-CD123 bispecific antibody or antigen-binding fragment thereof, wherein the antibody or antibody fragment directs the Vβ17-expressing CD8+ or CD4+ T cell to a cancer cell having CD123 on its surface.

In another general aspect, the invention relates to a method for inhibiting growth or proliferation of cancer cells. The methods comprise contacting the Vβ17-expressing CD8+ T cells with an anti-Vβ17/anti-CD123 bispecific antibody or antigen-binding fragment thereof, wherein contacting the cancer cells with the antibody or antibody fragment inhibits the growth or proliferation of the cancer cells.

According to embodiments of the invention, the described anti-Vβ17 antibody or antigen-binding fragment thereof can be provided in a buffered composition for storage or use. Suitable buffers for the storage of the described anti-Vβ17 antibody or antigen-binding fragment thereof would serve to maintain the stability of the antibody or antibody fragment by minimizing deterioration while stored, not promoting aggregation of the antibody or antibody fragment, or minimizing adhesion to the storage vessel.

According to embodiments of the invention, the described anti-Vβ17/anti-CD123 bispecific antibody or antigen-binding fragment thereof can be provided in a buffered composition for storage or use. Suitable buffers for the storage of the described anti-Vβ17/anti-CD123 bispecific antibody or antigen-binding fragment thereof would serve to maintain the stability of the antibody or antibody fragment by minimizing deterioration while stored, not promoting aggregation of the antibody or antibody fragment, or minimizing adhesion to the storage vessel.

According to embodiments of the invention, the described anti-Vβ17/anti-BCMA bispecific antibody or antigen-binding fragment thereof can be provided in a buffered composition for storage or use. Suitable buffers for the storage of the described anti-Vβ17/anti-BCMA bispecific antibody or antigen-binding fragment thereof would serve to maintain the stability of the antibody or antibody fragment by minimizing deterioration while stored, not promoting aggregation of the antibody or antibody fragment, or minimizing adhesion to the storage vessel.

According to embodiments of the invention, the described anti-Vβ17/anti-DLL3 bispecific antibody or antigen-binding fragment thereof can be provided in a buffered composition for storage or use. Suitable buffers for the storage of the described anti-Vβ17/anti-DLL3 bispecific antibody or antigen-binding fragment thereof would serve to maintain the stability of the antibody or antibody fragment by minimizing deterioration while stored, not promoting aggregation of the antibody or antibody fragment, or minimizing adhesion to the storage vessel.

According to embodiments of the invention, the described anti-Vβ17/anti-PSMA bispecific antibody or antigen-binding fragment thereof can be provided in a buffered composition for storage or use. Suitable buffers for the storage of the described anti-Vβ17/anti-PSMA bispecific antibody or antigen-binding fragment thereof would serve to maintain the stability of the antibody or antibody fragment by minimizing deterioration while stored, not promoting aggregation of the antibody or antibody fragment, or minimizing adhesion to the storage vessel.

According to embodiments of the invention, the described anti-Vβ17/anti-KLK2 bispecific antibody or antigen-binding fragment thereof can be provided in a buffered composition for storage or use. Suitable buffers for the storage of the described anti-Vβ17/anti-KLK2 bispecific antibody or antigen-binding fragment thereof would serve to maintain the stability of the antibody or antibody fragment by minimizing deterioration while stored, not promoting aggregation of the antibody or antibody fragment, or minimizing adhesion to the storage vessel.

Also provided is a trispecific antibody provided herein for use in therapy. Also provided is a trispecific antibody provided herein for use in a method of treating a cancer in a subject. In some embodiments, the cancer is a leukemia. In some embodiments, the cancer is a lymphoma. In certain embodiments, the subject is a subject in need thereof. In a specific embodiment, the subject is a human.

As used herein, the term "effective amount" refers to an amount of an active ingredient or component that elicits the desired biological or medicinal response in a subject.

According to particular embodiments, an effective amount refers to the amount of therapy which is sufficient to achieve one, two, three, four, or more of the following effects: (i) reduce or ameliorate the severity of the disease, disorder or condition to be treated or a symptom associated therewith; (ii) reduce the duration of the disease, disorder or condition to be treated, or a symptom associated therewith; (iii) prevent the progression of the disease, disorder or condition to be treated, or a symptom associated therewith; (iv) cause regression of the disease, disorder or condition to be treated, or a symptom associated therewith; (v) prevent the development or onset of the disease, disorder or condition to be treated, or a symptom associated therewith; (vi) prevent the recurrence of the disease, disorder or condition to be treated, or a symptom associated therewith; (vii) reduce hospitalization of a subject having the disease, disorder or condition to be treated, or a symptom associated therewith; (viii) reduce hospitalization length of a subject having the disease, disorder or condition to be treated, or a symptom associated therewith; (ix) increase the survival of a subject with the disease, disorder or condition to be treated, or a symptom associated therewith; (xi) inhibit or reduce the disease, disorder or condition to be treated, or a symptom associated therewith in a subject; and/or (xii) enhance or improve the prophylactic or therapeutic effect(s) of another therapy.

The effective amount or dosage can vary according to various factors, such as the disease, disorder or condition to be treated, the means of administration, the target site, the physiological state of the subject (including, e.g., age, body weight, health), whether the subject is a human or an animal, other medications administered, and whether the treatment is prophylactic or therapeutic. Treatment dosages are optimally titrated to optimize safety and efficacy.

According to particular embodiments, the compositions described herein are formulated to be suitable for the intended route of administration to a subject. For example, the compositions described herein can be formulated to be suitable for intravenous, subcutaneous, or intramuscular administration.

As used herein, the terms "treat," "treating," and "treatment" are all intended to refer to an amelioration or reversal of at least one measurable physical parameter related to a cancer, which is not necessarily discernible in the subject, but can be discernible in the subject. The terms "treat," "treating," and "treatment," can also refer to causing regression, preventing the progression, or at least slowing down the progression of the disease, disorder, or condition. In a particular embodiment, "treat," "treating," and "treatment" refer to an alleviation, prevention of the development or onset, or reduction in the duration of one or more symptoms associated with the disease, disorder, or condition, such as a tumor or more preferably a cancer. In a particular embodiment, "treat," "treating," and "treatment" refer to prevention of the recurrence of the disease, disorder, or condition. In a particular embodiment, "treat," "treating," and "treatment" refer to an increase in the survival of a subject having the disease, disorder, or condition. In a particular embodiment, "treat," "treating," and "treatment" refer to elimination of the disease, disorder, or condition in the subject.

In some embodiments, an anti-Vβ17 bispecific antibody provided herein is used in combination with a supplemental therapy.

As used herein, the term "in combination," in the context of the administration of two or more therapies to a subject, refers to the use of more than one therapy. The use of the term "in combination" does not restrict the order in which therapies are administered to a subject. For example, a first therapy (e.g., a composition described herein) can be administered prior to (e.g., 5 minutes, 15 minutes, 30 minutes, 45 minutes, 1 hour, 2 hours, 4 hours, 6 hours, 12 hours, 16 hours, 24 hours, 48 hours, 72 hours, 96 hours, 1 week, 2 weeks, 3 weeks, 4 weeks, 5 weeks, 6 weeks, 8 weeks, or 12 weeks before), concomitantly with, or subsequent to (e.g., 5 minutes, 15 minutes, 30 minutes, 45 minutes, 1 hour, 2 hours, 4 hours, 6 hours, 12 hours, 16 hours, 24 hours, 48 hours, 72 hours, 96 hours, 1 week, 2 weeks, 3 weeks, 4 weeks, 5 weeks, 6 weeks, 8 weeks, or 12 weeks after) the administration of a second therapy to a subject.

Anti-Vβ17 antibodies provided herein may also be used as agents to detect Vβ17-expressing cells. Thus, in another methods, provided is a method of detecting a cell expressing Vβ17, comprising contacting a cell with a Vβ17 antibody provided herein. In certain embodiments, the detecting is by ELISA. In some embodiments, the detecting is by FACS analysis. Also provided are kits comprising a Vβ17 antibody provided herein, and instructions for use.

EMBODIMENTS

This invention provides the following non-limiting embodiments.

In one set of embodiments, provided are:

A1. An antibody that binds T Cell Receptor Beta Variable 17 (Vβ17), comprising:
(i) a VH comprising a VH CDR1 having an amino acid sequence of SEQ ID NO:48, a VH CDR2 having an amino acid sequence of SEQ ID NO:49, and a VH CDR3 having an amino acid sequence of SEQ ID NO:50; and (ii) a VL comprising a VL CDR1 having an amino acid sequence of SEQ ID NO:51, a VL CDR2 having an amino acid sequence of SEQ ID NO:52, and a VL CDR3 having an amino acid sequence of SEQ ID NO:53.

A2. The antibody of embodiment A1, wherein the antibody comprises:
a VH having an amino acid sequence of SEQ ID NO:77;
a VL having an amino acid sequence of SEQ ID NO:78; or
a VH having an amino acid sequence of SEQ ID NO:77, and a VL having an amino acid sequence of SEQ ID NO:78.

A3. An antibody that binds Vβ17, comprising: (i) a VH comprising a VH CDR1 having an amino acid sequence of SEQ ID NO:48, a VH CDR2 having an amino acid sequence of SEQ ID NO:54, and a VH CDR3 having an amino acid sequence of SEQ ID NO:55; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:58.

A4. The antibody of embodiment A3, wherein the antibody comprises:
a VH having an amino acid sequence of SEQ ID NO:79;
a VL having an amino acid sequence of SEQ ID NO:80; or
a VH having an amino acid sequence of SEQ ID NO:79, and a VL having an amino acid sequence of SEQ ID NO:80.

A5. An antibody that binds Vβ17, comprising: (i) a VH comprising a VH CDR1 having an amino acid sequence of SEQ ID NO:59, a VH CDR2 having an amino acid sequence of SEQ ID NO:49, and a VH CDR3 having an amino acid sequence of SEQ ID NO:60; and (ii) a VL comprising a VL CDR1 having an amino acid sequence of SEQ ID NO:61, a VL CDR2 having an amino acid sequence of SEQ ID NO:62, and a VL CDR3 having an amino acid sequence of SEQ ID NO:63.

A6. The antibody of embodiment A5, wherein the antibody comprises:
   a VH having an amino acid sequence of SEQ ID NO:81;
   a VL having an amino acid sequence of SEQ ID NO:82; or
   a VH having an amino acid sequence of SEQ ID NO:81, and a VL having an amino acid sequence of SEQ ID NO:82.

A7. An antibody that binds Vβ17, comprising: (i) a VH comprising a VH CDR1 having an amino acid sequence of SEQ ID NO:64, a VH CDR2 having an amino acid sequence of SEQ ID NO:65, and a VH CDR3 having an amino acid sequence of SEQ ID NO:66; and (ii) a VL comprising a VL CDR1 having an amino acid sequence of SEQ ID NO:67, a VL CDR2 having an amino acid sequence of SEQ ID NO:68, and a VL CDR3 having an amino acid sequence of SEQ ID NO:69.

A8. The antibody of embodiment A7, wherein the antibody comprises:
   a VH having an amino acid sequence of SEQ ID NO:83;
   a VL having an amino acid sequence of SEQ ID NO:84; or
   a VH having an amino acid sequence of SEQ ID NO:83, and a VL having an amino acid sequence of SEQ ID NO:84.

A9. An antibody that binds Vβ17, comprising: (i) a VH comprising a VH CDR1 having an amino acid sequence of SEQ ID NO:70, a VH CDR2 having an amino acid sequence of SEQ ID NO:49, and a VH CDR3 having an amino acid sequence of SEQ ID NO:71; and (ii) a VL comprising a VL CDR1 having an amino acid sequence of SEQ ID NO:61, a VL CDR2 having an amino acid sequence of SEQ ID NO:72, and a VL CDR3 having an amino acid sequence of SEQ ID NO:73.

A10. The antibody of embodiment A9, wherein the antibody comprises:
   a VH having an amino acid sequence of SEQ ID NO:85;
   a VL having an amino acid sequence of SEQ ID NO:86; or
   a VH having an amino acid sequence of SEQ ID NO:85, and a VL having an amino acid sequence of SEQ ID NO:86.

A11. An antibody that binds Vβ17, comprising: (i) a VH comprising a VH CDR1 having an amino acid sequence of SEQ ID NO:48, a VH CDR2 having an amino acid sequence of SEQ ID NO:74, and a VH CDR3 having an amino acid sequence of SEQ ID NO:75; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:76.

A12. The antibody of embodiment A11, wherein the antibody comprises:
   a VH having an amino acid sequence of SEQ ID NO:87;
   a VL having an amino acid sequence of SEQ ID NO:88; or
   a VH having an amino acid sequence of SEQ ID NO:87, and a VL having an amino acid sequence of SEQ ID NO:88.

A13. An antibody that binds Vβ17, comprising: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:664, a VL CDR2 having an amino acid sequence of SEQ ID NO:5, and a VL CDR3 having an amino acid sequence of SEQ ID NO:6.

A14. The antibody of embodiment A13, wherein the antibody comprises:
   a VH having an amino acid sequence of SEQ ID NO:21;
   a VL having an amino acid sequence of SEQ ID NO:665; or
   a VH having an amino acid sequence of SEQ ID NO:21, and a VL having an amino acid sequence of SEQ ID NO:665.

A15. The antibody of any one of embodiments A1 to A14, wherein the antibody is a humanized antibody.

A16. The antibody of any one of embodiments A1 to A15, wherein the antibody is an IgG antibody.

A17. The antibody of embodiment A16, wherein the IgG antibody is an IgG1, IgG2, IgG3, or IgG4 antibody.

A18. The antibody of any one of embodiments A1 to A17, wherein the antibody binds a Vβ17 antigen.

A19. The antibody of any one of embodiments A1 to A17, wherein antibody binds a Vβ17 epitope.

A20. The antibody of any one of embodiments A1 to A17, wherein the VH CDR1, VH CDR2, VH CDR3, VL CDR1, VL CDR2 and VL CDR3 form a binding site for an antigen of the Vβ17.

A21. The antibody of any one of embodiments A1 to A17, wherein the VH CDR1, VH CDR2, VH CDR3, VL CDR1, VL CDR2 and VL CDR3 form a binding site for an epitope of the Vβ17.

A22. The antibody of any one of embodiments A1 to A21, wherein the Vβ17 is present on a surface of a T cell.

A23. The antibody of any one of embodiments A1 to A22, wherein the antibody is bispecific or multivalent.

A24. The antibody of embodiment A23, wherein the antibody is capable of binding at least three antigens.

A25. The antibody of embodiment A23, wherein the antibody is capable of binding at least five antigens.

A26. The antibody of any one of embodiments A1 to A25, wherein the antibody is a multispecific antibody.

A27. A bispecific antibody comprising: (a) a first binding domain that binds to Vβ17, and (b) a second binding domain that binds to a second target that is not Vβ17.

A28. The bispecific antibody of embodiment A27, wherein the first binding domain comprises (i) a VH comprising a VH CDR1 having an amino acid sequence of SEQ ID NO:48, a VH CDR2 having an amino acid sequence of SEQ ID NO:49, and a VH CDR3 having an amino acid sequence of SEQ ID NO:50; and (ii) a VL comprising a VL CDR1 having an amino acid sequence of SEQ ID NO:51, a VL CDR2 having an amino acid sequence of SEQ ID NO:52, and a VL CDR3 having an amino acid sequence of SEQ ID NO:53.

A29. The bispecific antibody of embodiment A28, wherein the first binding domain comprises:
   a VH having an amino acid sequence of SEQ ID NO:77;
   a VL having an amino acid sequence of SEQ ID NO:78; or
   a VH having an amino acid sequence of SEQ ID NO:77, and a VL having an amino acid sequence of SEQ ID NO:78.

A30. The bispecific antibody of embodiment A27, wherein the first binding domain comprises: (i) a VH comprising a VH CDR1 having an amino acid sequence of SEQ ID NO:48, a VH CDR2 having an amino acid sequence of SEQ ID NO:54, and a VH CDR3 having an amino acid sequence of SEQ ID NO:55; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:58.

A31. The bispecific antibody of embodiment A30, wherein the first binding domain comprises:
a VH having an amino acid sequence of SEQ ID NO:79;
a VL having an amino acid sequence of SEQ ID NO:80;
or
a VH having an amino acid sequence of SEQ ID NO:79, and a VL having an amino acid sequence of SEQ ID NO:80.

A32. The bispecific antibody of embodiment A27, wherein the first binding domain comprises (i) a VH comprising a VH CDR1 having an amino acid sequence of SEQ ID NO:59, a VH CDR2 having an amino acid sequence of SEQ ID NO:49, and a VH CDR3 having an amino acid sequence of SEQ ID NO:60; and (ii) a VL comprising a VL CDR1 having an amino acid sequence of SEQ ID NO:61, a VL CDR2 having an amino acid sequence of SEQ ID NO:62, and a VL CDR3 having an amino acid sequence of SEQ ID NO:63.

A33. The bispecific antibody of embodiment A32, wherein the first binding domain comprises:
a VH having an amino acid sequence of SEQ ID NO:81;
a VL having an amino acid sequence of SEQ ID NO:82;
or
a VH having an amino acid sequence of SEQ ID NO:81, and a VL having an amino acid sequence of SEQ ID NO:82.

A34. The bispecific antibody of embodiment A27, wherein the first binding domain comprises: (i) a VH comprising a VH CDR1 having an amino acid sequence of SEQ ID NO:64, a VH CDR2 having an amino acid sequence of SEQ ID NO:65, and a VH CDR3 having an amino acid sequence of SEQ ID NO:66; and (ii) a VL comprising a VL CDR1 having an amino acid sequence of SEQ ID NO:67, a VL CDR2 having an amino acid sequence of SEQ ID NO:68, and a VL CDR3 having an amino acid sequence of SEQ ID NO:69.

A35. The bispecific antibody of embodiment A34, wherein the first binding domain comprises:
a VH having an amino acid sequence of SEQ ID NO:83;
a VL having an amino acid sequence of SEQ ID NO:84;
or
a VH having an amino acid sequence of SEQ ID NO:83, and a VL having an amino acid sequence of SEQ ID NO:84.

A36. The bispecific antibody of embodiment A27, wherein the first binding domain comprises: (i) a VH comprising a VH CDR1 having an amino acid sequence of SEQ ID NO:70, a VH CDR2 having an amino acid sequence of SEQ ID NO:49, and a VH CDR3 having an amino acid sequence of SEQ ID NO:71; and (ii) a VL comprising a VL CDR1 having an amino acid sequence of SEQ ID NO:61, a VL CDR2 having an amino acid sequence of SEQ ID NO:72, and a VL CDR3 having an amino acid sequence of SEQ ID NO:73.

A37. The bispecific antibody of embodiment A36, wherein the first binding domain comprises:
a VH having an amino acid sequence of SEQ ID NO:85;
a VL having an amino acid sequence of SEQ ID NO:86;
or
a VH having an amino acid sequence of SEQ ID NO:85, and a VL having an amino acid sequence of SEQ ID NO:86.

A38. The bispecific antibody of embodiment A27, wherein the first binding domain comprises: (i) a VH comprising a VH CDR1 having an amino acid sequence of SEQ ID NO:48, a VH CDR2 having an amino acid sequence of SEQ ID NO:74, and a VH CDR3 having an amino acid sequence of SEQ ID NO:75; and (ii) a VL comprising a VL CDR1 having an amino acid sequence of SEQ ID NO:56, a VL CDR2 having an amino acid sequence of SEQ ID NO:57, and a VL CDR3 having an amino acid sequence of SEQ ID NO:76.

A39. The bispecific antibody of embodiment A38, wherein the first binding domain comprises:
a VH having an amino acid sequence of SEQ ID NO:87;
a VL having an amino acid sequence of SEQ ID NO:88;
or
a VH having an amino acid sequence of SEQ ID NO:87, and a VL having an amino acid sequence of SEQ ID NO:88.

A40. The bispecific antibody of embodiment A27, wherein the first binding domain comprises: (i) a VH comprising a VH CDR1 having an amino acid sequence of SEQ ID NO:1, a VH CDR2 having an amino acid sequence of SEQ ID NO:2, and a VH CDR3 having an amino acid sequence of SEQ ID NO:3; and (ii) a VL comprising a VL CDR1 having an amino acid sequence of SEQ ID NO:664, a VL CDR2 having an amino acid sequence of SEQ ID NO:5, and a VL CDR3 having an amino acid sequence of SEQ ID NO:6.

A41. The bispecific antibody of embodiment A40, wherein the first binding domain comprises:
a VH having an amino acid sequence of SEQ ID NO:21;
a VL having an amino acid sequence of SEQ ID NO:665;
or
a VH having an amino acid sequence of SEQ ID NO:21, and a VL having an amino acid sequence of SEQ ID NO:665.

A42. The bispecific antibody of any one of embodiments A27 to A41, wherein the Vβ17 is present on a surface of a T cell.

A43. The bispecific antibody of any one of embodiments A27 to A42, wherein the first binding domain is humanized, the second binding domain is humanized, or both the first binding domain and the second binding domain are humanized.

A44. The bispecific antibody of any one of embodiments A27 to A43, wherein the bispecific antibody is an IgG antibody.

A45. The bispecific antibody of embodiment A44, wherein the IgG antibody is an IgG1, IgG2, IgG3, or IgG4 antibody.

A46. The bispecific antibody of any one of embodiments A27 to A45, wherein the first binding domain binds a Vβ17 antigen.

A47. The bispecific antibody of any one of embodiments A27 to A45, wherein the first binding domain binds a Vβ17 epitope.

A48. The bispecific antibody of any one of embodiments A27 to A46, wherein the VH CDR1, VH CDR2, VH CDR3, VL CDR1, VL CDR2 and VL CDR3 form a binding site for an antigen of the Vβ17.

A49. The bispecific antibody of any one of embodiments A27 to A46, wherein the VH CDR1, VH CDR2, VH CDR3, VL CDR1, VL CDR2 and VL CDR3 form a binding site for an epitope of the Vβ17.

A50. The bispecific antibody of any one of embodiments A27 to A49, wherein the second binding domain binds an antigen of the second target.

A51. The bispecific antibody of any one of embodiments A27 to A49, wherein the second binding domain binds an epitope of the second target.

A52. The bispecific antibody of any one of embodiments A27 to A49, wherein the VH CDR1, VH CDR2, VH CDR3, VL CDR1, VL CDR2 and VL CDR3 form a binding site for an antigen of the second target.

A53. The bispecific antibody of any one of embodiments A27 to A49, wherein the VH CDR1, VH CDR2, VH CDR3, VL CDR1, VL CDR2 and VL CDR3 form a binding site for an epitope of the second target.

A54. The bispecific antibody of any one of embodiments A27 to A53, wherein the second target is on a surface of a second cell.

A55. The bispecific antibody of embodiment A54, wherein the second cell is a cancer cell.

A56. The bispecific antibody of embodiment A55, wherein the second target is a tumor-specific antigen, a tumor associated antigen, or a neoantigen.

A57. The bispecific antibody of embodiment A55 or 56, wherein the cancer cell is a cell of an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer.

A58. The bispecific antibody of embodiment A57, wherein
(i) the adrenal cancer is an adrenocortical carcinoma (ACC), adrenal cortex cancer, pheochromocytoma, or neuroblastoma;
(ii) the anal cancer is a squamous cell carcinoma, cloacogenic carcinoma, adenocarcinoma, basal cell carcinoma, or melanoma;
(iii) the appendix cancer is a neuroendocrine tumor (NET), mucinous adenocarcinoma, goblet cell carcinoid, intestinal-type adenocarcinoma, or signet-ring cell adenocarcinoma;
(iv) the bile duct cancer is an extrahepatic bile duct cancer, adenocarcinomas, hilar bile duct cancer, perihilar bile duct cancer, distal bile duct cancer, or intrahepatic bile duct cancer;
(v) the bladder cancer is transitional cell carcinoma (TCC), papillary carcinoma, flat carcinoma, squamous cell carcinoma, adenocarcinoma, small-cell carcinoma, or sarcoma;
(vi) the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer;
(vii) the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma;
(viii) the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer;
(ix) the cervical cancer is a squamous cell carcinoma, or adenocarcinoma;
(x) the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma;
(xi) the esophageal cancer is an adenocarcinoma or squamous cell carcinoma;
(xii) the gall bladder cancer is an adenocarcinoma, papillary adenocarcinoma, adenosquamous carcinoma, squamous cell carcinoma, small cell carcinoma, or sarcoma;
(xiii) the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT);
(xiv) the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer;
(xv) the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL);
(xvi) the intestinal cancer is a small intestine cancer, small bowel cancer, adenocarcinoma, sarcoma, gastrointestinal stromal tumors, carcinoid tumors, or lymphoma;
(xvii) the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma;
(xviii) the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS);
(xix) the liver cancer is a hepatocellular carcinoma (HCC), fibrolamellar HCC, cholangiocarcinoma, angiosarcoma, or liver metastasis;
(xx) the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor;
(xxi) the melanoma is a superficial spreading melanoma, nodular melanoma, acral-lentiginous melanoma, lentigo maligna melanoma, amelanotic melanoma, desmoplastic melanoma, ocular melanoma, or metastatic melanoma;
(xxii) the mesothelioma is a pleural mesothelioma, peritoneal mesothelioma, pericardial mesothelioma, or testicular mesothelioma;
(xxiii) the multiple myeloma is an active myeloma or smoldering myeloma;

(xxiv) the neuroendocrine tumor, is a gastrointestinal neuroendocrine tumor, pancreatic neuroendocrine tumor, or lung neuroendocrine tumor;

(xxv) the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma;

(xxvi) the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma acuminatum, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer;

(xxvii) the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst;

(xxviii) the pancreatic cancer is a pancreatic exocrine gland cancer, pancreatic endocrine gland cancer, or pancreatic adenocarcinoma, islet cell tumor, or neuroendocrine tumor;

(xxix) the prostate cancer is a prostate adenocarcinoma, prostate sarcoma, transitional cell carcinoma, small cell carcinoma, or neuroendocrine tumor;

(xxx) the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer;

(xxxi) the skin cancer is a basal cell carcinoma, squamous cell carcinoma, melanoma, Merkel cell carcinoma, Kaposi sarcoma (KS), actinic keratosis, skin lymphoma, or keratoacanthoma;

(xxxii) the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma;

(xxxiii) the spinal cancer is a spinal metastatic tumor;

(xxxiv) the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid;

(xxxv) the testicular cancer is a seminoma, non-seminoma, embryonal carcinoma, yolk sac carcinoma, choriocarcinoma, teratoma, gonadal stromal tumor, leydig cell tumor, or sertoli cell tumor;

(xxxiv) the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer;

(xxxv) the thyroid cancer is a papillary carcinoma, follicular carcinoma, Hürthle cell carcinoma, medullary thyroid carcinoma, or anaplastic carcinoma;

(xxxvi) the uterine cancer is an endometrial cancer, endometrial adenocarcinoma, endometroid carcinoma, serous adenocarcinoma, adenosquamous carcinoma, uterine carcinosarcoma, uterine sarcoma, uterine leiomyosarcoma, endometrial stromal sarcoma, or undifferentiated sarcoma;

(xxxvii) the vaginal cancer is a squamous cell carcinoma, adenocarcinoma, melanoma, or sarcoma; or (xxxviii) the vulvar cancer is a squamous cell carcinoma or adenocarcinoma.

A59. The bispecific antibody of any one of embodiments A27 to A58, wherein the second target is angiopoietin, BCMA, CD19, CD20, CD22, CD25 (IL2-R), CD30, CD33, CD37, CD38, CD52, CD56, CD123 (IL-3R), cMET, DLL/Notch, EGFR, EpCAM, FGF, FGF-R, GD2, HER2, Mesothelin, Nectin-4, PDGFRα, RANKL, SLAMF7, TROP2, VEGF, VEGF-R, CEA, immature laminin receptor, TAG-72, HPV E6, HPV E7, BING-4, calcium-activated chloride channel 2, cyclin-B1, 9D7, EpCAM, EphA3, Her2/neu, telomerase, mesothelin, SAP-1, surviving, a BAGE family antigen, a CAGE family antigen, a GAGE family antigen, a MAGE family antigen, a SAGE family antigen, a XAGE family antigen, NY-ESO-1/LAGE-1, PRAME, SSX-2, Melan-A, MART-1, Gp100, pmel17, tyrosinase, TRP-1, TRP-2, P. polypeptide, MC1R, prostate-specific antigen, β-catenin, BRCA1, BRCA2, CDK4, CML66, fibronectin, MART-2, p53, Ras, TGF-βRII, or MUC1.

A60. The bispecific antibody of any one of embodiments A27 to A58, wherein the second target is CD123.

A61. The bispecific antibody of embodiment A60, wherein the second binding domain comprises: (i) a VH comprising a VH CDR1 having an amino acid sequence of SEQ ID NO:34, a VH CDR2 having an amino acid sequence of SEQ ID NO:35, and a VH CDR3 having an amino acid sequence of SEQ ID NO:36; and (ii) a VL comprising a VL CDR1 having an amino acid sequence of SEQ ID NO:37, a VL CDR2 having an amino acid sequence of SEQ ID NO:38, and a VL CDR3 having an amino acid sequence of SEQ ID NO:39.

A62. The bispecific antibody of any one of embodiments A27 to A58, wherein the second target is BCMA.

A63. The bispecific antibody of embodiment A62, wherein the second binding domain comprises: (i) a VH comprising a VH CDR1 having an amino acid sequence of SEQ ID NO:89, a VH CDR2 having an amino acid sequence of SEQ ID NO:90, and a VH CDR3 having an amino acid sequence of SEQ ID NO:91; and (ii) a VL comprising a VL CDR1 having an amino acid sequence of SEQ ID NO:92, a VL CDR2 having an amino acid sequence of SEQ ID NO:93, and a VL CDR3 having an amino acid sequence of SEQ ID NO:94.

A64. The bispecific antibody of embodiment A54, wherein the second cell is a B cell.

A65. The bispecific antibody of embodiment A64, wherein the antigen on the surface of the B cell is a CD1a, CD1b, CD1c, CD1d, CD2, CD5, CD6, CD9, CD11a, CD11b, CD11c, CD17, CD18, CD19, CD20, CD21, CD22, CD23, CD24, CD25, CD26, CD27, CD29, CD30, CD31, CD32a, CD32b, CD35, CD37, CD38, CD39, CD40, CD45, CD45RA, CD45RB, CD45RC, CD45RO, CD46, CD47, CD48, CD49b, CD49c, CD49d, CD50, CD52, CD53, CD54, CD55, CD58, CD60a, CD62L, CD63, CD68, CD69, CD70, CD72, CD73, CD74, CD75, CD75S, CD77, CD79a, CD79b, CD80, CD81, CD82, CD83, CD84, CD85E, CD85I, CD85J, CD86, CD92, CD95, CD97, CD98, CD99, CD100, CD102, CD108, CD119, CD120a, CD120b, CD121b, CD122, CD124, CD125, CD126, CD130, CD132, CD137, CD138, CD139, CD147, CD148, CD150, CD152, CD162, CD164, CD166, CD167a, CD170, CD171, CD175, CD175s, CD180, CD184, CD185, CD192, CD196, CD197, CD200, CD205, CD201a, CDw210b, CD212, CD213a1, CD213a2, CD215, CD217, CD218a, CD218b, CD220, CD221, CD222, CD224, CD225, CD226, CD227, CD229, CD230, CD232, CD252, CD252, CD254, CD255, CD256, CD257 CD258, CD259, CD260, CD261, CD262, CD263, CD264, CD267, CD268, CD269, CD270, CD272, CD274, CD275, CD277, CD279, CD283, CD289, CD290, CD295, CD298, CD300, CD300c, CD305, CD306, CD307a, CD307b, CD307c, CD307d, CD307e, CD314, CD215, CD316, CD317, CD319, CD321, CD327, CD328, CD329, CD338, CD351, CD352, CD353, CD354, CD355, CD356, CD357, CD358, CD360, CD361, CD362, or CD363 antigen.

A66. The bispecific antibody of embodiment A64, wherein the second target is BCMA.

A67. The bispecific antibody of embodiment A62, wherein the second binding domain comprises: (i) a VH comprising a VH CDR1 having an amino acid sequence of SEQ ID NO:89, a VH CDR2 having an amino acid sequence of SEQ ID NO:90, and a VH CDR3 having an amino acid sequence of SEQ ID NO:91; and (ii) a VL comprising a VL CDR1 having an amino acid sequence of SEQ ID NO:92, a VL CDR2 having an amino acid sequence of SEQ ID NO:93, and a VL CDR3 having an amino acid sequence of SEQ ID NO:94.

A68. The bispecific antibody of any one of embodiments A54 to 67, wherein the second cell is killed when the bispecific antibody binds to the Vβ17 on the surface of the T cell and binds to the second target on the surface of the second cell.

A69. The bispecific antibody of embodiment A68, wherein the bispecific antibody induces T cell dependent cytotoxicity of the second cell in vitro with an $EC_{50}$ of less than about 500 pM.

A70. The bispecific antibody of embodiment A68, wherein the bispecific antibody induces T cell dependent cytotoxicity of the second cell in vitro with an $EC_{50}$ of less than about 300 pM.

A71. The bispecific antibody of embodiment A68, wherein the bispecific antibody induces T cell dependent cytotoxicity of the second cell in vitro with an $EC_{50}$ of less than about 160 pM.

A72. The bispecific antibody of any one of embodiments A69 to A71, wherein the $EC_{50}$ is assessed with a mixture of αβ T effector cells and target cells expressing the second target.

A73. The bispecific antibody of embodiment A72, wherein the effector cells to target cells ratio is about 0.01 to 1 to about 10 to 1.

A74. The bispecific antibody of embodiment A72, wherein the effector cells to target cells ratio is about 0.1 to 1 to about 5 to 1.

A75. The bispecific antibody of embodiment A72, wherein the effector cell to target cell ratio is about 1:1.

A76. The bispecific antibody of any one of embodiments A27 to A75, wherein the bispecific antibody is multivalent.

A77. The bispecific antibody of embodiment A76, wherein the bispecific antibody is capable of binding at least three antigens.

A78. The bispecific antibody of embodiment A72, wherein the bispecific antibody is capable of binding at least five antigens.

A79. A bispecific antibody comprising: a first means capable of binding Vβ17 on the surface of the T cell; and a second means capable of binding a second target that is not Vβ17.

A80. The bispecific antibody of embodiment A79, wherein the second target is on a surface of a second cell.

A81. A nucleic acid encoding the bispecific antibody of any one of embodiments A1 to A26 or the bispecific antibody of any one of embodiments A27 to A80.

A82. A vector comprising the nucleic acid of embodiment A81.

A83. A host cell comprising the vector of embodiment A82.

A84. A kit comprising the vector of embodiment A83 and packaging comprising a compartment for holding the vector.

A85. A pharmaceutical composition comprising the bispecific antibody of any one of embodiments A1 to A26 or the bispecific antibody of any one of embodiments A27 to A80, and a pharmaceutically acceptable carrier.

A86. A method of producing the pharmaceutical composition of embodiment A85, comprising combining the bispecific antibody with a pharmaceutically acceptable carrier to obtain the pharmaceutical composition.

A87. A method of directing a T cell expressing Vβ17 to a second target, the method comprising contacting the T cell with the bispecific antibody of any one of embodiments A27 to A80, wherein the contacting directs the T cell to the second target.

A88. A method of inhibiting growth or proliferation of target cells expressing the second target on the cell surface, the method comprising contacting the target cells with the bispecific antibody of any one of embodiments A27 to A80, wherein contacting the target cells with the bispecific antibody inhibits growth or proliferation of the target cells.

A89. The method of embodiment A88, wherein the target cells are in the presence of a T cell expressing Vβ17 while in contact with the bispecific antibody.

A90. A method for eliminating target cells expressing the second target in a subject, the method comprising administering an effective amount of the bispecific antibody of any one of embodiments A27 to A80 to the subject.

A91. The method of embodiment A90, wherein the subject has a cancer.

A92. The method of embodiment A90, wherein the subject has a leukemia.

A93. The method of embodiment A90, wherein the subject has a lymphoma.

A94. A method of treating a disease caused all or in part by target cells expressing the second target in a subject, comprising administering an effective amount of the bispecific antibody of any one of embodiments A27 to A80 to the subject.

A95. The method of embodiment A94, wherein the disease is cancer.

A96. The method of embodiment A94, wherein the disease is a leukemia.

A97. The method of embodiment A94, wherein the disease is a lymphoma.

A98. The method of embodiment A91 or A95, wherein the cancer is an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer.

A99. The method of embodiment A98, wherein
- (i) the adrenal cancer is an adrenocortical carcinoma (ACC), adrenal cortex cancer, pheochromocytoma, or neuroblastoma;
- (ii) the anal cancer is a squamous cell carcinoma, cloacogenic carcinoma, adenocarcinoma, basal cell carcinoma, or melanoma;
- (iii) the appendix cancer is a neuroendocrine tumor (NET), mucinous adenocarcinoma, goblet cell carcinoid, intestinal-type adenocarcinoma, or signet-ring cell adenocarcinoma;
- (iv) the bile duct cancer is an extrahepatic bile duct cancer, adenocarcinomas, hilar bile duct cancer, perihilar bile duct cancer, distal bile duct cancer, or intrahepatic bile duct cancer;
- (v) the bladder cancer is transitional cell carcinoma (TCC), papillary carcinoma, flat carcinoma, squamous cell carcinoma, adenocarcinoma, small-cell carcinoma, or sarcoma;
- (vi) the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer;
- (vii) the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma;
- (viii) the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer;
- (ix) the cervical cancer is a squamous cell carcinoma, or adenocarcinoma;
- (x) the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma;
- (xi) the esophageal cancer is an adenocarcinoma or squamous cell carcinoma;
- (xii) the gall bladder cancer is an adenocarcinoma, papillary adenocarcinoma, adenosquamous carcinoma, squamous cell carcinoma, small cell carcinoma, or sarcoma;
- (xiii) the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT);
- (xiv) the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer;
- (xv) the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL);
- (xvi) the intestinal cancer is a small intestine cancer, small bowel cancer, adenocarcinoma, sarcoma, gastrointestinal stromal tumors, carcinoid tumors, or lymphoma;
- (xvii) the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma;
- (xviii) the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS);
- (xix) the liver cancer is a hepatocellular carcinoma (HCC), fibrolamellar HCC, cholangiocarcinoma, angiosarcoma, or liver metastasis;
- (xx) the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor;
- (xxi) the melanoma is a superficial spreading melanoma, nodular melanoma, acral-lentiginous melanoma, lentigo maligna melanoma, amelanotic melanoma, desmoplastic melanoma, ocular melanoma, or metastatic melanoma;
- (xxii) the mesothelioma is a pleural mesothelioma, peritoneal mesothelioma, pericardial mesothelioma, or testicular mesothelioma;

(xxiii) the multiple myeloma is an active myeloma or smoldering myeloma;

(xxiv) the neuroendocrine tumor, is a gastrointestinal neuroendocrine tumor, pancreatic neuroendocrine tumor, or lung neuroendocrine tumor;

(xxv) the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma;

(xxvi) the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma acuminatum, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer;

(xxvii) the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst;

(xxviii) the pancreatic cancer is a pancreatic exocrine gland cancer, pancreatic endocrine gland cancer, or pancreatic adenocarcinoma, islet cell tumor, or neuroendocrine tumor;

(xxix) the prostate cancer is a prostate adenocarcinoma, prostate sarcoma, transitional cell carcinoma, small cell carcinoma, or neuroendocrine tumor;

(xxx) the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer;

(xxxi) the skin cancer is a basal cell carcinoma, squamous cell carcinoma, melanoma, Merkel cell carcinoma, Kaposi sarcoma (KS), actinic keratosis, skin lymphoma, or keratoacanthoma;

(xxxii) the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma;

(xxxiii) the spinal cancer is a spinal metastatic tumor;

(xxxiv) the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid;

(xxxv) the testicular cancer is a seminoma, non-seminoma, embryonal carcinoma, yolk sac carcinoma, choriocarcinoma, teratoma, gonadal stromal tumor, leydig cell tumor, or sertoli cell tumor;

(xxxiv) the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer;

(xxxv) the thyroid cancer is a papillary carcinoma, follicular carcinoma, Hürthle cell carcinoma, medullary thyroid carcinoma, or anaplastic carcinoma;

(xxxvi) the uterine cancer is an endometrial cancer, endometrial adenocarcinoma, endometroid carcinoma, serous adenocarcinoma, adenosquamous carcinoma, uterine carcinosarcoma, uterine sarcoma, uterine leiomyosarcoma, endometrial stromal sarcoma, or undifferentiated sarcoma;

(xxxvii) the vaginal cancer is a squamous cell carcinoma, adenocarcinoma, melanoma, or sarcoma; or (xxxviii) the vulvar cancer is a squamous cell carcinoma or adenocarcinoma.

A100. The method of any one of embodiments A90 to A99, wherein the subject is a subject in need thereof.

A101. The method of any one of embodiments A90 to A100, wherein the subject is a human.

A102. A method of activating a T cell expressing Vβ17, comprising contacting the T cell with the bispecific antibody of any one of embodiments A27 to A80.

A103. The method of embodiment A102, wherein the contacting results in an increase in CD69, CD25, and/or Granzyme B expression, as compared to a control T cell expressing Vβ17 without the contacting.

A104. A process for making an antibody that binds to more than one target molecule, the process comprising:
   a step for performing a function of obtaining a binding domain capable of binding to Vβ17 on a T cell;
   a step for performing a function of obtaining a binding domain capable of binding to a second target on a second cell; and a step for performing a function of providing an antibody capable of binding to the Vβ17 on the T cell and capable of binding to the second target on the second cell.

A105. The process of embodiment A104, wherein the step for performing the function of obtaining the binding domain capable of binding to the second target is repeated n times, and wherein the process further comprises n steps for performing the function of obtaining the binding domain capable of binding to the Vβ17 on the T cell, and n number of target molecules, wherein n is at least 2.

A106. The process of embodiment A104 or 105, wherein the second target is on the surface of the second cell.

A107. The process of any one of embodiments A104 to A106, wherein the second cell is a cancer cell.

A108. The process of any one of embodiments A104 to A106, wherein the second cell is a B cell.

A109. The process of any one of embodiments A104 to A106, wherein the second target is CD123.

A110. The process of any one of embodiments A104 to A106, wherein the second target is BCMA.

A111. The process of embodiment A107, wherein the cancer is an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer.

A112. The method of embodiment A111, wherein
(i) the adrenal cancer is an adrenocortical carcinoma (ACC), adrenal cortex cancer, pheochromocytoma, or neuroblastoma;
(ii) the anal cancer is a squamous cell carcinoma, cloacogenic carcinoma, adenocarcinoma, basal cell carcinoma, or melanoma;
(iii) the appendix cancer is a neuroendocrine tumor (NET), mucinous adenocarcinoma, goblet cell carcinoid, intestinal-type adenocarcinoma, or signet-ring cell adenocarcinoma;
(iv) the bile duct cancer is an extrahepatic bile duct cancer, adenocarcinomas, hilar bile duct cancer, perihilar bile duct cancer, distal bile duct cancer, or intrahepatic bile duct cancer;
(v) the bladder cancer is transitional cell carcinoma (TCC), papillary carcinoma, flat carcinoma, squamous cell carcinoma, adenocarcinoma, small-cell carcinoma, or sarcoma;
(vi) the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer;
(vii) the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma;
(viii) the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer;
(ix) the cervical cancer is a squamous cell carcinoma, or adenocarcinoma;
(x) the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma;
(xi) the esophageal cancer is an adenocarcinoma or squamous cell carcinoma;
(xii) the gall bladder cancer is an adenocarcinoma, papillary adenocarcinoma, adenosquamous carcinoma, squamous cell carcinoma, small cell carcinoma, or sarcoma;
(xiii) the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT);
(xiv) the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer;
(xv) the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL);
(xvi) the intestinal cancer is a small intestine cancer, small bowel cancer, adenocarcinoma, sarcoma, gastrointestinal stromal tumors, carcinoid tumors, or lymphoma;
(xvii) the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma;
(xviii) the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS);
(xix) the liver cancer is a hepatocellular carcinoma (HCC), fibrolamellar HCC, cholangiocarcinoma, angiosarcoma, or liver metastasis;
(xx) the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor;
(xxi) the melanoma is a superficial spreading melanoma, nodular melanoma, acral-lentiginous melanoma, lentigo maligna melanoma, amelanotic melanoma, desmoplastic melanoma, ocular melanoma, or metastatic melanoma;
(xxii) the mesothelioma is a pleural mesothelioma, peritoneal mesothelioma, pericardial mesothelioma, or testicular mesothelioma;
(xxiii) the multiple myeloma is an active myeloma or smoldering myeloma;

(xxiv) the neuroendocrine tumor, is a gastrointestinal neuroendocrine tumor, pancreatic neuroendocrine tumor, or lung neuroendocrine tumor;

(xxv) the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma;

(xxvi) the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma acuminatum, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer;

(xxvii) the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst;

(xxviii) the pancreatic cancer is a pancreatic exocrine gland cancer, pancreatic endocrine gland cancer, or pancreatic adenocarcinoma, islet cell tumor, or neuroendocrine tumor;

(xxix) the prostate cancer is a prostate adenocarcinoma, prostate sarcoma, transitional cell carcinoma, small cell carcinoma, or neuroendocrine tumor;

(xxx) the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer;

(xxxi) the skin cancer is a basal cell carcinoma, squamous cell carcinoma, melanoma, Merkel cell carcinoma, Kaposi sarcoma (KS), actinic keratosis, skin lymphoma, or keratoacanthoma;

(xxxii) the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma;

(xxxiii) the spinal cancer is a spinal metastatic tumor;

(xxxiv) the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid;

(xxxv) the testicular cancer is a seminoma, non-seminoma, embryonal carcinoma, yolk sac carcinoma, choriocarcinoma, teratoma, gonadal stromal tumor, leydig cell tumor, or sertoli cell tumor;

(xxxiv) the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer;

(xxxv) the thyroid cancer is a papillary carcinoma, follicular carcinoma, Hürthle cell carcinoma, medullary thyroid carcinoma, or anaplastic carcinoma;

(xxxvi) the uterine cancer is an endometrial cancer, endometrial adenocarcinoma, endometroid carcinoma, serous adenocarcinoma, adenosquamous carcinoma, uterine carcinosarcoma, uterine sarcoma, uterine leiomyosarcoma, endometrial stromal sarcoma, or undifferentiated sarcoma;

(xxxvii) the vaginal cancer is a squamous cell carcinoma, adenocarcinoma, melanoma, or sarcoma; or (xxxviii) the vulvar cancer is a squamous cell carcinoma or adenocarcinoma.

A113. The process of embodiment A108, wherein the second target is CD1a, CD1b, CD1c, CD1d, CD2, CD5, CD6, CD9, CD11a, CD11b, CD11c, CD17, CD18, CD19, CD20, CD21, CD22, CD23, CD24, CD25, CD26, CD27, CD29, CD30, CD31, CD32a, CD32b, CD35, CD37, CD38, CD39, CD40, CD45, CD45RA, CD45RB, CD45RC, CD45RO, CD46, CD47, CD48, CD49b, CD49c, CD49d, CD50, CD52, CD53, CD54, CD55, CD58, CD60a, CD62L, CD63, CD68, CD69, CD70, CD72, CD73, CD74, CD75, CD75S, CD77, CD79a, CD79b, CD80, CD81, CD82, CD83, CD84, CD85E, CD85I, CD85J, CD86, CD92, CD95, CD97, CD98, CD99, CD100, CD102, CD108, CD119, CD120a, CD120b, CD121b, CD122, CD124, CD125, CD126, CD130, CD132, CD137, CD138, CD139, CD147, CD148, CD150, CD152, CD162, CD164, CD166, CD167a, CD170, CD171, CD175, CD175s, CD180, CD184, CD185, CD192, CD196, CD197, CD200, CD205, CD201a, CDw210b, CD212, CD213a1, CD213a2, CD215, CD217, CD218a, CD218b, CD220, CD221, CD222, CD224, CD225, CD226, CD227, CD229, CD230, CD232, CD252, CD252, CD254, CD255, CD256, CD257 CD258, CD259, CD260, CD261, CD262, CD263, CD264, CD267, CD268, CD269, CD270, CD272, CD274, CD275, CD277, CD279, CD283, CD289, CD290, CD295, CD298, CD300, CD300c, CD305, CD306, CD307a, CD307b, CD307c, CD307d, CD307e, CD314, CD215, CD316, CD317, CD319, CD321, CD327, CD328, CD329, CD338, CD351, CD352, CD353, CD354, CD355, CD356, CD357, CD358, CD360, CD361, CD362, or CD363.

A114. The process of any one of embodiments A104 to A113, wherein the binding domain capable of binding to Vβ17 binds a Vβ17 antigen.

A115. The process of any one of embodiments A104 to A113, wherein the binding domain capable of binding to Vβ17 binds a Vβ17 epitope.

A116. The process of any one of embodiments A104 to A115, wherein the binding domain capable of binding to a second target binds an antigen of the second target.

A117. The process of any one of embodiments A104 to A115, wherein the binding domain capable of binding to a second target binds an epitope of the second target.

A118. A bispecific antibody comprising: a first means capable of binding Vβ17 on a surface of a T cell; and a second means capable of binding a second target on a surface of a second cell.

A119. The bispecific antibody of embodiment A118, wherein the second cell is a cancer cell.

A120. The bispecific antibody of embodiment A118, wherein the second cell is a B cell.

A121. The bispecific antibody of embodiment A118, wherein the second target is CD123.

A122. The bispecific antibody of embodiment A118, wherein the second target is BCMA.

A123. The bispecific antibody of embodiment A118, wherein the cancer cell is a cancer cell from an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer.

A124. The bispecific antibody of embodiment A123, wherein
  (i) the adrenal cancer is an adrenocortical carcinoma (ACC), adrenal cortex cancer, pheochromocytoma, or neuroblastoma;
  (ii) the anal cancer is a squamous cell carcinoma, cloacogenic carcinoma, adenocarcinoma, basal cell carcinoma, or melanoma;
  (iii) the appendix cancer is a neuroendocrine tumor (NET), mucinous adenocarcinoma, goblet cell carcinoid, intestinal-type adenocarcinoma, or signet-ring cell adenocarcinoma;
  (iv) the bile duct cancer is an extrahepatic bile duct cancer, adenocarcinomas, hilar bile duct cancer, perihilar bile duct cancer, distal bile duct cancer, or intrahepatic bile duct cancer;
  (v) the bladder cancer is transitional cell carcinoma (TCC), papillary carcinoma, flat carcinoma, squamous cell carcinoma, adenocarcinoma, small-cell carcinoma, or sarcoma;
  (vi) the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer;
  (vii) the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma;
  (viii) the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer;
  (ix) the cervical cancer is a squamous cell carcinoma, or adenocarcinoma;
  (x) the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma;
  (xi) the esophageal cancer is an adenocarcinoma or squamous cell carcinoma;
  (xii) the gall bladder cancer is an adenocarcinoma, papillary adenocarcinoma, adenosquamous carcinoma, squamous cell carcinoma, small cell carcinoma, or sarcoma;
  (xiii) the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT);
  (xiv) the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer;
  (xv) the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL);
  (xvi) the intestinal cancer is a small intestine cancer, small bowel cancer, adenocarcinoma, sarcoma, gastrointestinal stromal tumors, carcinoid tumors, or lymphoma;
  (xvii) the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma;
  (xviii) the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS);
  (xix) the liver cancer is a hepatocellular carcinoma (HCC), fibrolamellar HCC, cholangiocarcinoma, angiosarcoma, or liver metastasis;
  (xx) the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor;
  (xxi) the melanoma is a superficial spreading melanoma, nodular melanoma, acral-lentiginous melanoma, lentigo maligna melanoma, amelanotic melanoma, desmoplastic melanoma, ocular melanoma, or metastatic melanoma;
(xxii) the mesothelioma is a pleural mesothelioma, peritoneal mesothelioma, pericardial mesothelioma, or testicular mesothelioma;
(xxiii) the multiple myeloma is an active myeloma or smoldering myeloma;
(xxiv) the neuroendocrine tumor, is a gastrointestinal neuroendocrine tumor, pancreatic neuroendocrine tumor, or lung neuroendocrine tumor;
(xxv) the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma;
(xxvi) the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma acuminatum, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer;
(xxvii) the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst;
(xxviii) the pancreatic cancer is a pancreatic exocrine gland cancer, pancreatic endocrine gland cancer, or pancreatic adenocarcinoma, islet cell tumor, or neuroendocrine tumor;
(xxix) the prostate cancer is a prostate adenocarcinoma, prostate sarcoma, transitional cell carcinoma, small cell carcinoma, or neuroendocrine tumor;
(xxx) the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer;
(xxxi) the skin cancer is a basal cell carcinoma, squamous cell carcinoma, melanoma, Merkel cell carcinoma, Kaposi sarcoma (KS), actinic keratosis, skin lymphoma, or keratoacanthoma;
(xxxii) the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma;
(xxxiii) the spinal cancer is a spinal metastatic tumor;
(xxxiv) the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid;
(xxxv) the testicular cancer is a seminoma, non-seminoma, embryonal carcinoma, yolk sac carcinoma, choriocarcinoma, teratoma, gonadal stromal tumor, leydig cell tumor, or sertoli cell tumor;
(xxxiv) the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer;
(xxxv) the thyroid cancer is a papillary carcinoma, follicular carcinoma, Hürthle cell carcinoma, medullary thyroid carcinoma, or anaplastic carcinoma;
(xxxvi) the uterine cancer is an endometrial cancer, endometrial adenocarcinoma, endometroid carcinoma, serous adenocarcinoma, adenosquamous carcinoma, uterine carcinosarcoma, uterine sarcoma, uterine leiomyosarcoma, endometrial stromal sarcoma, or undifferentiated sarcoma;
(xxxvii) the vaginal cancer is a squamous cell carcinoma, adenocarcinoma, melanoma, or sarcoma; or
(xxxviii) the vulvar cancer is a squamous cell carcinoma or adenocarcinoma.

A125. The bispecific antibody of embodiment A119, wherein the second target is CD1a, CD1b, CD1c, CD1d, CD2, CD5, CD6, CD9, CD11a, CD11b, CD11c, CD17, CD18, CD19, CD20, CD21, CD22, CD23, CD24, CD25, CD26, CD27, CD29, CD30, CD31, CD32a, CD32b, CD35, CD37, CD38, CD39, CD40, CD45, CD45RA, CD45RB, CD45RC, CD45RO, CD46, CD47, CD48, CD49b, CD49c, CD49d, CD50, CD52, CD53, CD54, CD55, CD58, CD60a, CD62L, CD63, CD68, CD69, CD70, CD72, CD73, CD74, CD75, CD75S, CD77, CD79a, CD79b, CD80, CD81, CD82, CD83, CD84, CD85E, CD85I, CD85J, CD86, CD92, CD95, CD97, CD98, CD99, CD100, CD102, CD108, CD119, CD120a, CD120b, CD121b, CD122, CD124, CD125, CD126, CD130, CD132, CD137, CD138, CD139, CD147, CD148, CD150, CD152, CD162, CD164, CD166, CD167a, CD170, CD171, CD175, CD175s, CD180, CD184, CD185, CD192, CD196, CD197, CD200, CD205, CD201a, CDw210b, CD212, CD213a1, CD213a2, CD215, CD217, CD218a, CD218b, CD220, CD221, CD222, CD224, CD225, CD226, CD227, CD229, CD230, CD232, CD252, CD252, CD254, CD255, CD256, CD257 CD258, CD259, CD260, CD261, CD262, CD263, CD264, CD267, CD268, CD269, CD270, CD272, CD274, CD275, CD277, CD279, CD283, CD289, CD290, CD295, CD298, CD300, CD300c, CD305, CD306, CD307a, CD307b, CD307c, CD307d, CD307e, CD314, CD215, CD316, CD317, CD319, CD321, CD327, CD328, CD329, CD338, CD351, CD352, CD353, CD354, CD355, CD356, CD357, CD358, CD360, CD361, CD362, or CD363.

A126. The bispecific antibody of any one of embodiments A118 to A125, wherein the first means capable of binding to the Vβ17 binds a Vβ17 antigen.

A127. The bispecific antibody of any one of embodiments A118 to A125, wherein the first means capable of binding to the Vβ17 binds a Vβ17 epitope.

A128. The bispecific antibody of any one of embodiments A118 to A127, wherein the second means capable of binding to the second target binds an antigen of the second target.

A129. The bispecific antibody of any one of embodiments A118 to A127, wherein the second means capable of binding to the second target binds an epitope of the second target.

A130. Embodiment A130 is an isolated Vβ17 bispecific antibody or antigen-binding fragment thereof, the isolated Vβ17 bispecific antibody or antigen-binding fragment thereof comprising:
 (a) a first heavy chain (HC1);
 (b) a second heavy chain (HC2);
 (c) a first light chain (LC1); and
 (d) a second light chain (LC2),
  wherein HC1 is associated with LC1 and HC2 is associated with LC2, and wherein HC1 comprises a heavy chain complementarity determining region 1 (HCDR1), HCDR2, and HCDR3 comprising the amino acid sequences of SEQ ID NO:1, SEQ ID NO:2, and SEQ ID NO:3, respectively, and LC1 comprises a light chain complementarity determining region 1 (LCDR1), LCDR2, and LCDR3 comprising the amino acid sequences of SEQ ID NO:4, SEQ ID NO:5, and SEQ ID NO:6, respectively, to form a binding site for a first antigen, and wherein HC2 and LC2 form a binding site for a second antigen.

A131. Embodiment A131 is the Vβ17 bispecific antibody or antigen-binding fragment thereof of embodiment A130, wherein the binding site for the first antigen binds to Vβ17 on a CD8+ or CD4+ T cell.

A132. Embodiment A132 is the Vβ17 bispecific antibody or antigen-binding fragment thereof of embodiment A130 or 131, wherein the binding site for the second antigen binds to a tumor antigen present on the surface of a cancer cell.

A133. Embodiment A133 is the Vβ17 bispecific antibody or antigen-binding fragment of any one of embodiments A130 to 132, wherein HC1 and LC1 are humanized.

A134. Embodiment A134 is the Vβ17 bispecific antibody or antigen-binding fragment thereof of any one of embodiments A130 to 133, wherein HC2 and LC2 bind to CD123.

A135. Embodiment A135 is the Vβ17 bispecific antibody or antigen-binding fragment thereof of any one of embodiments A130 to 134, wherein the bispecific antibody or antigen-binding fragment thereof is a IgG isotype.

A136. Embodiment A136 is the Vβ17 bispecific antibody or antigen-binding fragment thereof of any one of embodiments A130 to 135, wherein the bispecific antibody or antigen-binding fragment thereof is a IgG4 isotype.

A137. Embodiment A137 is the Vβ17 bispecific antibody or antigen-binding fragment thereof of any one of embodiments A130 to 136, wherein the bispecific antibody or antigen-binding fragment thereof induces CD8+ or CD4+ T-cell dependent cytotoxicity of a cancer cell in vitro with an $EC_{50}$ of less than about 0.2 pM.

A138. Embodiment A138 is an isolated nucleic acid encoding HC1 and LC1 of the Vβ17 bispecific antibody or antigen-binding fragment thereof of any one of embodiments A130 to A137.

A139. Embodiment A139 is an isolated nucleic acid encoding HC2 and LC2 of the Vβ17 bispecific antibody or antigen-binding fragment thereof of any one of embodiments A130 to A137.

A140. Embodiment A140 is a vector comprising the isolated nucleic acid of embodiment A138 or embodiment A139.

A141. Embodiment A141 is a host cell comprising the vector of embodiment A140.

A142. Embodiment A142 is a buffered composition comprising the isolated Vβ17 bispecific antibody or antigen-binding fragment thereof of any one of embodiments A1 to 137 and a buffered solution.

A143. Embodiment A143 is an isolated anti-Vβ17/anti-CD123 bispecific antibody or antigen-binding fragment thereof comprising:
 (a) a first heavy chain (HC1);
 (b) a second heavy chain (HC2)
 (c) a first light chain (LC1); and
 (d) a second light chain (LC2),
  wherein HC1 is associated with LC1 and HC2 is associated with LC2, and wherein HC1 comprises a heavy chain complementarity determining region 1 (HCDR1), HCDR2, and HCDR3 comprising the amino acid sequences of SEQ ID NO:1, SEQ ID NO:2, and SEQ ID NO:3, respectively, and LC1 comprises a light chain complementarity determining region 1 (LCDR1), LCDR2, and LCDR3 comprising the amino acid sequences of SEQ ID NO:4, SEQ ID NO:5, and SEQ ID NO:6, respectively, to form a binding site for a first antigen that specifically binds Vβ17, and wherein HC2 comprises a heavy chain complementarity determining region 1 (HCDR1), HCDR2, and HCDR3 comprising the amino acid sequences of SEQ ID NO:34, SEQ ID NO:35, and SEQ ID NO:36, respectively, and LC2 comprises a light chain complementarity determining region 1 (LCDR1), LCDR2, and LCDR3 comprising the amino acid sequences of SEQ ID NO:37, SEQ ID NO:38, and SEQ ID NO:39, respectively, to form a binding site for a second antigen that specifically binds CD123.

A144. Embodiment A144 is the isolated anti-Vβ17/anti-CD123 bispecific antibody or antigen-binding fragment of embodiment A139, wherein HC1 comprises the amino acid sequence of SEQ ID NO:13 and LC1 comprises the amino acid sequence of SEQ ID NO:14, and wherein HC2 comprises the amino acid sequence of SEQ ID NO:15 and LC2 comprises the amino acid sequence of SEQ ID NO:16.

A145. Embodiment A145 is the isolated anti-Vβ17/anti-CD123 bispecific antibody or antigen-binding fragment thereof of embodiment A143 or embodiment A144, wherein the Vβ17 is on the surface of a CD8+ or CD4+ T cell.

A146. Embodiment A146 is the isolated anti-Vβ17/anti-CD123 bispecific antibody or antigen-binding fragment thereof of any one of embodiments A143 to 145, wherein the CD123 is on the surface of a cancer cell.

A147. Embodiment A147 is the isolated anti-Vβ17/anti-CD123 bispecific antibody or antigen-binding fragment thereof of any one of embodiments A143 to 146, wherein bispecific antibody or antigen-binding fragment thereof induces CD8+ or CD4+ T-cell dependent cytotoxicity of a cancer cell in vitro with an $EC_{50}$ of less than about 0.2 pM.

A148. Embodiment A148 is an isolated nucleic acid encoding the HC1 and LC1 of the anti-Vβ17/anti-CD123 bispecific antibody or antigen-binding fragment thereof of any one of embodiments A143 to 147.

A149. Embodiment A149 is an isolated nucleic acid encoding the HC2 and LC2 of the anti-Vβ17/anti-CD123 bispecific antibody or antigen-binding fragment thereof of any one of embodiments A143 to 147.

A150. Embodiment A150 is a vector comprising the isolated nucleic acid of embodiment A148 or embodiment A149.

A151. Embodiment A151 is a host cell comprising the vector of embodiment A150.

A152. Embodiment A152 is a buffered composition comprising the isolated anti-Vβ17/anti-CD123 bispecific antibody or antigen-binding fragment thereof of any one of embodiments A143 to 147 and a buffered solution.

A153. Embodiment A153 is a method of directing a Vβ17-expressing CD8+ or CD4+ T cell to a cancer cell, the method comprising contacting a Vβ17-expressing CD8+ or CD4+ T cell with the anti-Vβ17/anti-CD123 bispecific antibody or antigen-binding fragment thereof of any one of embodiments A130 to 137 or 143 to 147, wherein contacting the Vβ17-expressing CD8+ or CD4+ T cell with the anti-Vβ17/anti-CD123 bispecific antibody or antigen-binding fragment thereof directs the Vβ17-expressing CD8+ or CD4+ T cell to a cancer cell having CD123 on its surface. Embodiment A153(a) is the method of embodiment A153, wherein the Vβ17-expressing CD8+ or CD4+ T cell is contacted with an anti-Vβ17/anti-CD123 bispecific antibody of any one of embodiments A130 to 137 or 143 to 147. Embodiment A149(b) is the method of embodiment A153, wherein the Vβ17-expressing CD8+ or CD4+ T cell is contacted with an anti-Vβ17/anti-CD123 bispecific antibody fragment of any one of embodiments A130 to 137 or 142 to 147.

A154. Embodiment A154 is a method for inhibiting growth or proliferation of cancer cells expressing CD123 on its surface, the method comprising contacting the cancer cells with the anti-Vβ17/anti-CD123 bispecific antibody or fragment thereof with any one of embodiments A130 to 137 or 144 to 147, wherein contacting the cancer cells with said antibody or antibody fragment inhibits the growth or proliferation of the cancer cells. Embodiment A154(a) is the method of embodiments A154, wherein the CD123-expressing cancer cell is in the presence of a Vβ17-expressing CD8+ T cell while in contact with an anti-Vβ17/anti-CD123 bispecific antibody or fragment thereof. Embodiment A154 (b) is the method of embodiment A154 or 154(a), wherein the CD123-expressing cancer cell is contacted with an anti-Vβ17/anti-CD123 bispecific antibody of any one of embodiments A130 to 137 or 143 to 147. Embodiment A150(c) is the method of embodiment A150 or 150(a), wherein the CD123-expressing cancer cell is contacted with an anti-Vβ17/anti-CD123 bispecific antibody fragment of any one of embodiments A130 to 137 or 143 to 147.

A155. Embodiment A155 is a kit comprising a Vβ17 bispecific antibody or antigen-binding fragment thereof of any one of embodiments A130 to 137 and packaging for the same.

A156. Embodiment A156 is a kit comprising an anti-Vβ17/anti-CD123 bispecific antibody or antigen-binding fragment thereof of any one of embodiments A143 to A147 and packaging for the same.

A157. Embodiment A157 is a method of producing a Vβ17 bispecific antibody or antigen-binding fragment thereof, comprising culturing the host cell of embodiment A141 under conditions to produce the Vβ17 bispecific antibody or antigen-binding fragment thereof, and recovering the Vβ17 bispecific antibody or antigen-binding fragment thereof from the cell or culture.

A158. Embodiment A158 is a method of producing an anti-Vβ17/anti-CD123 bispecific antibody or antigen-binding fragment thereof of any one of embodiments A143 to A147, comprising culturing the host cell of embodiment A151 under conditions to produce the anti-Vβ17/anti-CD123 bispecific antibody or antigen-binding fragment thereof, and recovering the anti-Vβ17/anti-CD123 bispecific antibody or antigen-binding fragment thereof from the cell or culture.

A159. Embodiment A159 is an isolated humanized Vβ17 monoclonal antibody or antigen-binding fragment thereof, the Vβ17 monoclonal antibody or antigen-binding fragment thereof comprising an amino acid sequence with at least 95% identity to the amino acid sequence of SEQ ID NO:28.

A160. Embodiment A160 is isolated humanized Vβ17 monoclonal antibody or antigen-binding fragment thereof of embodiment A159, wherein the Vβ17 monoclonal antibody or antigen-binding fragment thereof comprises the amino acid sequence of SEQ ID NO:28.

A161. Embodiment A161 is an isolated nucleic acid encoding the humanized Vβ17 monoclonal antibody or antigen-binding fragment thereof of embodiment A159 or embodiment A160.

A162. Embodiment A162 is a vector comprising the isolated nucleic acid of embodiment A161.

A163. Embodiment A163 is a host cell comprising the vector of embodiment A162.

A164. Embodiment A164 is a buffered composition comprising the isolated humanized Vβ17 monoclonal antibody or antigen-binding fragment thereof of embodiment A159 or embodiment A160.

A165. Embodiment A165 is an antibody or antigen binding fragment thereof as defined in any one of the preceding embodiments or in the appended claims for use in therapy.

A166. Embodiment A166 is an antibody or antigen binding fragment thereof as defined in any one of the preceding embodiments or in the appended claims for use in the treatment of cancer.

A167. Embodiment A167 is an antibody or antigen binding fragment thereof for use according to embodiment A166, wherein the cancer is a cancer as defined in any of embodiments A96 to A99.

A168. An antibody that binds to Vα10.2, comprising:
(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:568; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:569; or (2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:570; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:571.

A169. The antibody of embodiment A168, wherein the VH CDR1, VH CDR2, VH CDR3, VL CDR1, VL CDR2, and VL CDR3 amino acid sequences are according to the Kabat numbering system.

A170. The antibody of embodiment A168, wherein the VH CDR1, VH CDR2, VH CDR3, VL CDR1, VL CDR2, and VL CDR3 amino acid sequences are according to the Chothia numbering system.

A171. The antibody of embodiment A168, wherein the VH CDR1, VH CDR2, VH CDR3, VL CDR1, VL CDR2, and VL CDR3 amino acid sequences are according to the AbM numbering system.

A172. The antibody of embodiment A168, wherein the VH CDR1, VH CDR2, VH CDR3, VL CDR1, VL CDR2, and VL CDR3 amino acid sequences are according to the Contact numbering system.

A173. The antibody of embodiment A168, wherein the VH CDR1, VH CDR2, VH CDR3, VL CDR1, VL CDR2, and VL CDR3 amino acid sequences are according to the IMGT numbering system.

A174. The antibody of embodiment A168, wherein the VH CDR1, VH CDR2, VH CDR3, VL CDR1, VL CDR2, and VL CDR3 amino acid sequences are according to the Exemplary numbering system.

A175. The antibody of any one of embodiments A168 to A174, wherein the antibody is
  (i) a humanized antibody,
  (ii) an IgG antibody, wherein optionally the IgG antibody is an IgG1, IgG2, IgG3, or IgG4 antibody,
  (iii) comprises a kappa light chain or a lambda light chain, and/or
  (iv) a monoclonal antibody.

A176. The antibody of any one of embodiments A168 to A175, wherein the antibody binds a Vα10.2 antigen.

A177. The antibody of any one of embodiments A168 to A176, wherein antibody binds a Vα10.2 epitope.

A178. The antibody of any one of embodiments A168 to A177, wherein the antibody specifically binds to Vα10.2.

A179. The antibody of any one of embodiments A168 to A178, wherein the VH CDR1, VH CDR2, VH CDR3, VL CDR1, VL CDR2 and VL CDR3 form a binding site for an antigen of the Vα10.2.

A180. The antibody of any one of embodiments A168 to A179, wherein the VH CDR1, VH CDR2, VH CDR3, VL CDR1, VL CDR2 and VL CDR3 form a binding site for an epitope of the Vα10.2.

A181. The antibody of any one of embodiments A168 to A180, wherein the Vα10.2 is present on the surface of a T cell.

A182. The antibody of any one of embodiments A168 to A181, wherein the antibody is multivalent.

A183. The antibody of any one of embodiments A168 to A182, wherein the antibody is a multispecific antibody.

A184. The antibody of any one of embodiments A168 to A183, wherein the antibody is a bispecific antibody.

A185. The antibody of embodiment A183 or A184, wherein the antibody further binds to a second target, wherein the second target is BCMA.

In a second set of embodiments, provided are:

B1. An antibody that binds to Vβ17, comprising:
(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:21; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:677;
(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:77; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:78;
(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:79; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:80;
(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:81; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:82;
(5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:83; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:84;
(6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:85; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:86;
(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:87; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:88;
(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1000; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1001;

(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1032; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1033;

(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1064; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1065;

(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1096; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1097; or

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:1128; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:1129.

B2. The antibody of embodiment B1, wherein the VH CDR1, VH CDR2, VH CDR3, VL CDR1, VL CDR2, and VL CDR3 amino acid sequences are according to the Kabat numbering system.

B3. The antibody of embodiment B1, wherein the VH CDR1, VH CDR2, VH CDR3, VL CDR1, VL CDR2, and VL CDR3 amino acid sequences are according to the Chothia numbering system.

B4. The antibody of embodiment B1, wherein the VH CDR1, VH CDR2, VH CDR3, VL CDR1, VL CDR2, and VL CDR3 amino acid sequences are according to the AbM numbering system.

B5. The antibody of embodiment B1, wherein the VH CDR1, VH CDR2, VH CDR3, VL CDR1, VL CDR2, and VL CDR3 amino acid sequences are according to the Contact numbering system.

B6. The antibody of embodiment B1, wherein the VH CDR1, VH CDR2, VH CDR3, VL CDR1, VL CDR2, and VL CDR3 amino acid sequences are according to the IMGT numbering system.

B7. The antibody of embodiment B1, wherein the VH CDR1, VH CDR2, VH CDR3, VL CDR1, VL CDR2, and VL CDR3 amino acid sequences are according to the Exemplary numbering system.

B8. The antibody of any one of embodiments B1 to B7, wherein the antibody is a humanized antibody.

B9. The antibody of any one of embodiments B1 to B8, wherein the antibody is an IgG antibody.

B10. The antibody of embodiment B9, wherein the IgG antibody is an IgG1, IgG2, IgG3, or IgG4 antibody.

B11. The antibody of any one of embodiments B1 to B10, wherein the antibody comprises a kappa light chain.

B12. The antibody of any one of embodiments B1 to B10, wherein the antibody comprises a lambda light chain.

B13. The antibody of any one of embodiments B1 to B12, wherein the antibody is a monoclonal antibody.

B14. The antibody of any one of embodiments B1 to B13, wherein the antibody binds a Vβ17 antigen.

B15. The antibody of any one of embodiments B1 to B13, wherein antibody binds a Vβ17 epitope.

B16. The antibody of any one of embodiments B1 to B15, wherein the antibody specifically binds to Vβ17.

B17. The antibody of any one of embodiments B1 to B16, wherein the VH CDR1, VH CDR2, VH CDR3, VL CDR1, VL CDR2 and VL CDR3 form a binding site for an antigen of the Vβ17.

B18. The antibody of any one of embodiments B1 to B16, wherein the VH CDR1, VH CDR2, VH CDR3, VL CDR1, VL CDR2 and VL CDR3 form a binding site for an epitope of the Vβ17.

B19. The antibody of any one of embodiments B1 to B18, wherein the Vβ17 is present on the surface of a T cell.

B20. The antibody of any one of embodiments B1 to B19, wherein the antibody is multivalent.

B21. The antibody of embodiment B20, wherein the antibody is capable of binding at least three antigens.

B22. The antibody of embodiment B20, wherein the antibody is capable of binding at least four antigens.

B23. The antibody of embodiment B20, wherein the antibody is capable of binding at least five antigens.

B24. The antibody of any one of embodiments B1 to B23, wherein the antibody is a multispecific antibody.

B25. A multispecific Vβ17 antibody, comprising
(a) a first binding domain that binds to Vβ17, wherein the first binding domain comprises a Vβ17 antibody of any one of embodiments B1 to B23, and
(b) a second binding domain that binds to a second target that is not Vβ17.

B26. The multispecific Vβ17 antibody of embodiment B25, wherein the antibody is a bispecific antibody.

B27. The multispecific Vβ17 antibody of embodiment B25, wherein the antibody is a trispecific antibody.

B28. The multispecific Vβ17 antibody of embodiment B25, wherein the antibody is a quadraspecific antibody.

B29. The multispecific Vβ17 antibody of any one of embodiments B25 to B28, wherein the second binding domain binds an antigen of the second target.

B30. The multispecific Vβ17 antibody of any one of embodiments B25 to B28, wherein the second binding domain binds an epitope of the second target.

B31. The multispecific Vβ17 antibody of any one of embodiments B25 to B30, wherein the second binding domain specifically binds to the second target.

B32. The multispecific Vβ17 antibody of any one of embodiments B25 to B31, wherein the VH CDR1, VH CDR2, VH CDR3, VL CDR1, VL CDR2 and VL CDR3 of the second binding domain form a binding site for an antigen of the second target.

B33. The multispecific Vβ17 antibody of any one of embodiments B25 to B31, wherein the VH CDR1, VH CDR2, VH CDR3, VL CDR1, VL CDR2 and VL CDR3 of the second binding domain form a binding site for an epitope of the second target.

B34. The multispecific Vβ17 antibody of any one of embodiments B25 to B33, wherein the second target is present on the surface of a target cell.

B35. The multispecific Vβ17 antibody of any one of embodiments B25 to B34, wherein the second binding domain that binds the second target is multivalent.

B36. The multispecific Vβ17 antibody of embodiment B35, wherein the second binding domain is capable of binding at least three antigens.

B37. The multispecific Vβ17 antibody of embodiment B35, wherein the second binding domain is capable of binding at least four antigens.

B38. The multispecific Vβ17 antibody of embodiment B35, wherein the second binding domain is capable of binding at least five antigens.

B39. The multispecific Vβ17 antibody of any one of embodiment B25 to B38, wherein the second target is CD123.

B40. The multispecific Vβ17 antibody of embodiment B39, wherein the second binding arm that binds CD123 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:40; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:41.

B41. A multispecific antibody that binds to Vβ17, comprising:

(a) a first binding domain that binds to Vβ17, wherein the first binding domain comprises:

(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:25; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:26;

(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:7; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:8;

(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:9; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:10;

(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:19; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:22;

(5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:19; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:23;

(6) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:19; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:24;

(7) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:20; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:22;

(8) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:20; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:23;

(9) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:20; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:24;

(10) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:21; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:22;

(11) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:21; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:23;

(12) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:21; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:24; or

(13) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:46; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:49; and (b) a second binding domain that binds to a second target that is BCMA, DLL3, PSMA or KLK2.

B42. The multispecific Vβ17 antibody of embodiment B41, wherein the VH CDR1, VH CDR2, VH CDR3, VL CDR1, VL CDR2, and VL CDR3 amino acid sequences of the first binding arm are according to the Kabat numbering system.

B43. The multispecific Vβ17 antibody of embodiment B41, wherein the VH CDR1, VH CDR2, VH CDR3, VL CDR1, VL CDR2, and VL CDR3 amino acid sequences of the first binding arm are according to the Chothia numbering system.

B44. The multispecific Vβ17 antibody of embodiment B41, wherein the VH CDR1, VH CDR2, VH CDR3, VL CDR1, VL CDR2, and VL CDR3 amino acid sequences of the first binding arm are according to the AbM numbering system.

B45. The multispecific Vβ17 antibody of embodiment B41, wherein the VH CDR1, VH CDR2, VH CDR3, VL CDR1, VL CDR2, and VL CDR3 amino acid sequences of the first binding arm are according to the Contact numbering system.

B46. The multispecific Vβ17 antibody of embodiment B41, wherein the VH CDR1, VH CDR2, VH CDR3, VL CDR1, VL CDR2, and VL CDR3 amino acid sequences of the first binding arm are according to the IMGT numbering system.

B47. The multispecific Vβ17 antibody of embodiment B41, wherein the VH CDR1, VH CDR2, VH CDR3, VL CDR1, VL CDR2, and VL CDR3 amino acid sequences of the first binding arm are according to the Exemplary numbering system.

B48. The multispecific Vβ17 antibody of any one of embodiment B25 to B38 or B41 to B47, wherein the second target is BCMA.

B49. The multispecific Vβ17 antibody of embodiment B48, wherein the second binding arm that binds BCMA comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:95; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:96.

B50. The multispecific Vβ17 antibody of any one of embodiment B25 to B38 or B41 to B47, wherein the second target is DLL3.

B51. The multispecific Vβ17 antibody of embodiment B50, wherein the second binding arm that binds DLL3 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:694; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:695.

B52. The multispecific Vβ17 antibody of any one of embodiment B25 to B38 or B41 to B47, wherein the second target is PSMA.

B53. The multispecific Vβ17 antibody of embodiment B52, wherein the second binding arm that binds PSMA comprises:

(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:730; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:731;

(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:732; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:733;

(3) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:734; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:735;

(4) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:736; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:737; or (5) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:899; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:900.

B54. The multispecific Vβ17 antibody of any one of embodiment B25 to B38 or B41 to B47, wherein the second target is KLK2.

B55. The multispecific Vβ17 antibody of embodiment B54, wherein the second binding arm that binds KLK2 comprises: (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:887; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:888.

B56. The multispecific Vβ17 antibody of any one of embodiments B40, B49, B51, B53, or B55, wherein the VH CDR1, VH CDR2, VH CDR3, VL CDR1, VL CDR2, and VL CDR3 amino acid sequences of the second binding arm are according to the Kabat numbering system.

B57. The multispecific Vβ17 antibody of any one of embodiments B40, B49, B51, B53, or B55, wherein the VH CDR1, VH CDR2, VH CDR3, VL CDR1, VL CDR2, and VL CDR3 amino acid sequences of the second binding arm are according to the Chothia numbering system.

B58. The multispecific Vβ17 antibody of any one of embodiments B40, B49, B51, B53, or B55, wherein the VH CDR1, VH CDR2, VH CDR3, VL CDR1, VL CDR2, and VL CDR3 amino acid sequences of the second binding arm are according to the AbM numbering system.

B59. The multispecific Vβ17 antibody of any one of embodiments B40, B49, B51, B53, or B55, wherein the VH CDR1, VH CDR2, VH CDR3, VL CDR1, VL CDR2, and VL CDR3 amino acid sequences of the second binding arm are according to the Contact numbering system.

B60. The multispecific Vβ17 antibody of any one of B40, B49, B51, B53, or B55, wherein the VH CDR1, VH CDR2, VH CDR3, VL CDR1, VL CDR2, and VL CDR3 amino acid sequences of the second binding arm are according to the IMGT numbering system.

B61. The multispecific Vβ17 antibody of any one of embodiments B40, B49, B51, B53, or B55, wherein the VH CDR1, VH CDR2, VH CDR3, VL CDR1, VL CDR2, and VL CDR3 amino acid sequences of the second binding arm are according to the Exemplary numbering system.

B62. A multispecific Vβ17 antibody, comprising a first means capable of binding Vβ17 on the surface of the T cell; and a second means capable of binding a second target that is not Vβ17.

B63. The multispecific Vβ17 antibody of embodiment B62, wherein the second target is present on the surface of a target cell.

B64. A nucleic acid encoding the antibody of any one of embodiments B1 to B63.

B65. A vector comprising the nucleic acid of embodiment B64.

B66. A host cell comprising the vector of embodiment B65.

B67. A kit comprising the vector of embodiment B66 and packaging for the same.

B68. A kit comprising the antibody of any one of embodiments B1 to B63 and packaging for the same.

B69. A pharmaceutical composition comprising the antibody of any one of embodiments B1 to B63, and a pharmaceutically acceptable carrier.

B70. A method of producing the pharmaceutical composition of embodiment B69, comprising combining the antibody with a pharmaceutically acceptable carrier to obtain the pharmaceutical composition.

B71. A method of activating a T cell expressing Vβ17, comprising contacting the T cell with the antibody of any one of embodiments B1 to B63.

B72. The method of embodiment B71, wherein the contacting results in an increase in CD69, CD25, and/or Granzyme B expression, as compared to a control T cell expressing Vβ17.

B73. A process for making an antibody that binds to more than one target molecule, the process comprising: a step for performing a function of obtaining a first binding domain that binds to Vβ17 present on a T cell; a step for performing a function of obtaining a second binding domain that binds to a second target on the surface of a target cell; and a step for performing a function of providing an antibody that binds to Vβ17 present on a T cell and a second target on the surface of a target cell.

B74. The process of embodiment B73, wherein the step for performing a function of obtaining a second binding domain that binds to a second target on the surface of a target cell is repeated n times, and further comprising n steps for performing a function of providing a first binding domain that binds to Vβ17 present on a T cell and n number of target molecules, wherein n is at least 2.

B75. A method of directing a T cell expressing Vβ17 to a target cell, comprising contacting the multispecific Vβ17 antibody of any one of embodiments B25 to 63 with the target cell, wherein the second target is present on the surface of the target cell, and wherein the contacting directs the T cell to the target cell.

B76. A method of inhibiting the growth or proliferation of a target cell, comprising contacting the multispecific Vβ17 antibody of any one of embodiments B25 to B63 with the target cell having the second target present on the surface of the target cell, wherein the contacting is in the presence of a T cell expressing the Vβ17, and wherein the contacting results in the inhibition of the growth or proliferation of the target cell.

B77. A method of eliminating a target cell in a subject, comprising contacting the multispecific Vβ17 antibody of any one of embodiments B25 to B63 with the target cell having the second target present on the surface of the target cell, wherein the contacting is in the presence of a T cell expressing the Vβ17, and wherein the contacting results in the elimination of the target cell.

B78. A method of treating a disease in a subject, comprising administering an effective amount of the multispecific Vβ17 antibody of any one of embodiments B25 to B63 to the subject, wherein the disease is caused all or in part by a target cell having the second target present on the surface of the target cell.

B79. The method of embodiment B77 or 78, wherein the subject is a human.

B80. The method of any one of embodiments B77 to B79, wherein the subject is a subject in need thereof.

B81. The multispecific Vβ17 antibody of any one of embodiments B25 to B63 or the method of any one of embodiments B75 to B80, wherein the second target is present on the surface of a target cell, and wherein the target cell is a cancer cell.

B82. The multispecific Vβ17 antibody or method of embodiment B81, wherein
(i) the cancer cell is a cell of an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer;

(ii) the second target is angiopoietin, BCMA, CD19, CD20, CD22, CD25 (IL2-R), CD30, CD33, CD37, CD38, CD52, CD56, CD123 (IL-3R), cMET, DLL/Notch, EGFR, EpCAM, FGF, FGF-R, GD2, HER2, Mesothelin, Nectin-4, PAP, PDGFRα, PSA, PSA3, PSMA, RANKL, SLAMF7, STEAP1, TARP, TROP2, VEGF, or VEGF-R; and/or (iii) the second target is CEA, immature laminin receptor, TAG-72, HPV E6, HPV E7, BING-4, calcium-activated chloride channel 2, cyclin-B1, 9D7, EpCAM, EphA3, Her2/neu, telomerase, mesothelin, SAP-1, surviving, a BAGE family antigen, CAGE family antigen, GAGE family antigen, MAGE family antigen, SAGE family antigen, XAGE family antigen, NY-ESO-1/LAGE-1, PRAME, SSX-2, Melan-A, MART-1, Gp100, pmel17, tyrosinase, TRP-1, TRP-2, P. polypeptide, MC1R, prostate-specific antigen, β-catenin, or BRCA1.

B83. The multispecific Vβ17 antibody or method of embodiment B81, wherein the second target is CD123.

B84. The multispecific Vβ17 antibody or method of embodiment B81, wherein the second target is BCMA.

B85. The multispecific Vβ17 antibody or method of embodiment B81, wherein the second target is DLL3.

B86. The multispecific Vβ17 antibody or method of embodiment B81, wherein the second target is PSMA.

B87. The multispecific Vβ17 antibody or method of embodiment B81, wherein the second target is KLK2.

B88. The multispecific Vβ17 antibody or method of embodiment B82, wherein (i) the adrenal cancer is an adrenocortical carcinoma (ACC), adrenal cortex cancer, pheochromocytoma, or neuroblastoma;

(ii) the anal cancer is a squamous cell carcinoma, cloacogenic carcinoma, adenocarcinoma, basal cell carcinoma, or melanoma;

(iii) the appendix cancer is a neuroendocrine tumor (NET), mucinous adenocarcinoma, goblet cell carcinoid, intestinal-type adenocarcinoma, or signet-ring cell adenocarcinoma;

(iv) the bile duct cancer is an extrahepatic bile duct cancer, adenocarcinomas, hilar bile duct cancer, perihilar bile duct cancer, distal bile duct cancer, or intrahepatic bile duct cancer;

(v) the bladder cancer is transitional cell carcinoma (TCC), papillary carcinoma, flat carcinoma, squamous cell carcinoma, adenocarcinoma, small-cell carcinoma, or sarcoma;

(vi) the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer;

(vii) the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma;

(viii) the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer;

(ix) the cervical cancer is a squamous cell carcinoma, or adenocarcinoma;

(x) the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma;

(xi) the esophageal cancer is an adenocarcinoma or squamous cell carcinoma;

(xii) the gall bladder cancer is an adenocarcinoma, papillary adenocarcinoma, adenosquamous carcinoma, squamous cell carcinoma, small cell carcinoma, or sarcoma;

(xiii) the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT);

(xiv) the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer;

(xv) the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL);

(xvi) the intestinal cancer is a small intestine cancer, small bowel cancer, adenocarcinoma, sarcoma, gastrointestinal stromal tumors, carcinoid tumors, or lymphoma;

(xvii) the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma;

(xviii) the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS);

(xix) the liver cancer is a hepatocellular carcinoma (HCC), fibrolamellar HCC, cholangiocarcinoma, angiosarcoma, or liver metastasis;

(xx) the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor;

(xxi) the melanoma is a superficial spreading melanoma, nodular melanoma, acral-lentiginous melanoma, lentigo maligna melanoma, amelanotic melanoma, desmoplastic melanoma, ocular melanoma, or metastatic melanoma;

(xxii) the mesothelioma is a pleural mesothelioma, peritoneal mesothelioma, pericardial mesothelioma, or testicular mesothelioma;

(xxiii) the multiple myeloma is an active myeloma or smoldering myeloma;

(xxiv) the neuroendocrine tumor, is a gastrointestinal neuroendocrine tumor, pancreatic neuroendocrine tumor, or lung neuroendocrine tumor;
(xxv) the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma;
(xxvi) the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma acuminatum, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer;
(xxvii) the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst;
(xxviii) the pancreatic cancer is a pancreatic exocrine gland cancer, pancreatic endocrine gland cancer, or pancreatic adenocarcinoma, islet cell tumor, or neuroendocrine tumor;
(xxix) the prostate cancer is a prostate adenocarcinoma, prostate sarcoma, transitional cell carcinoma, small cell carcinoma, or neuroendocrine tumor;
(xxx) the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer;
(xxxi) the skin cancer is a basal cell carcinoma, squamous cell carcinoma, melanoma, Merkel cell carcinoma, Kaposi sarcoma (KS), actinic keratosis, skin lymphoma, or keratoacanthoma;
(xxxii) the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma;
(xxxiii) the spinal cancer is a spinal metastatic tumor;
(xxxiv) the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid;
(xxxv) the testicular cancer is a seminoma, non-seminoma, embryonal carcinoma, yolk sac carcinoma, choriocarcinoma, teratoma, gonadal stromal tumor, leydig cell tumor, or sertoli cell tumor;
(xxxiv) the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer;
(xxxv) the thyroid cancer is a papillary carcinoma, follicular carcinoma, Hürthle cell carcinoma, medullary thyroid carcinoma, or anaplastic carcinoma;
(xxxvi) the uterine cancer is an endometrial cancer, endometrial adenocarcinoma, endometroid carcinoma, serous adenocarcinoma, adenosquamous carcinoma, uterine carcinosarcoma, uterine sarcoma, uterine leiomyosarcoma, endometrial stromal sarcoma, or undifferentiated sarcoma;
(xxxvii) the vaginal cancer is a squamous cell carcinoma, adenocarcinoma, melanoma, or sarcoma; or
(xxxviii) the vulvar cancer is a squamous cell carcinoma or adenocarcinoma.

B89. The multispecific Vβ17 antibody of any one of embodiments B25 to B63 or the method of any one of embodiments B75 to B80, wherein the second target is present on the surface of a target cell, and wherein the target cell is a B cell.

B90. The multispecific Vβ17 antibody or method of embodiment B89, wherein the second target is CD1a, CD1b, CD1c, CD1d, CD2, CD5, CD6, CD9, CD11a, CD11b, CD11c, CD17, CD18, CD19, CD20, CD21, CD22, CD23, CD24, CD25, CD26, CD27, CD29, CD30, CD31, CD32a, CD32b, CD35, CD37, CD38, CD39, CD40, CD45, CD45RA, CD45RB, CD45RC, CD45RO, CD46, CD47, CD48, CD49b, CD49c, CD49d, CD50, CD52, CD53, CD54, CD55, CD58, CD60a, CD62L, CD63, CD68, CD69, CD70, CD72, CD73, CD74, CD75, CD75S, CD77, CD79a, CD79b, CD80, CD81, CD82, CD83, CD84, CD85E, CD85I, CD85J, CD86, CD92, CD95, CD97, CD98, CD99, CD100, CD102, CD108, CD119, CD120a, CD120b, CD121b, CD122, CD124, CD125, CD126, CD130, CD132, CD137, CD138, CD139, CD147, CD148, CD150, CD152, CD162, CD164, CD166, CD167a, CD170, CD171, CD175, CD175s, CD180, CD184, CD185, CD192, CD196, CD197, CD200, CD205, CD201a, CDw210b, CD212, CD213a1, CD213a2, CD215, CD217, CD218a, CD218b, CD220, CD221, CD222, CD224, CD225, CD226, CD227, CD229, CD230, CD232, CD252, CD252, CD254, CD255, CD256, CD257 CD258, CD259, CD260, CD261, CD262, CD263, CD264, CD267-270, CD272, CD274, CD275, CD277, CD279, CD283, CD289, CD290, CD295, CD298, CD300, CD300c, CD305, CD306, CD307a, CD307b, CD307c, CD307d, CD307e, CD314, CD215, CD316, CD317, CD319, CD321, CD327, CD328, CD329, CD338, CD351, CD352, CD353, CD354, CD355, CD356, CD357, CD358, CD360, CD361, CD362 or CD363.

B91. The multispecific Vβ17 antibody or method of embodiment B89, wherein the second target is BCMA.

B92. An antibody that binds to Vα10.2, comprising:
(1) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:568; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:569; or
(2) (i) a VH comprising a VH CDR1, a VH CDR2, and a VH CDR3 having an amino acid sequence of a VH CDR1, a VH CDR2, and a VH CDR3, respectively, of a VH having an amino acid sequence of SEQ ID NO:570; and (ii) a VL comprising a VL CDR1, a VL CDR2, and a VL CDR3 having an amino acid sequence of a VL CDR1, a VL CDR2, and a VL CDR3, respectively, of a VL having an amino acid sequence of SEQ ID NO:571.

B93. The antibody of embodiment B92, wherein the VH CDR1, VH CDR2, VH CDR3, VL CDR1, VL CDR2, and VL CDR3 amino acid sequences are according to the Kabat numbering system.

B94. The antibody of embodiment B92, wherein the VH CDR1, VH CDR2, VH CDR3, VL CDR1, VL CDR2, and VL CDR3 amino acid sequences are according to the Chothia numbering system.

B95. The antibody of embodiment B92, wherein the VH CDR1, VH CDR2, VH CDR3, VL CDR1, VL CDR2, and VL CDR3 amino acid sequences are according to the AbM numbering system.

B96. The antibody of embodiment B92, wherein the VH CDR1, VH CDR2, VH CDR3, VL CDR1, VL CDR2, and VL CDR3 amino acid sequences are according to the Contact numbering system.

B97. The antibody of embodiment B92, wherein the VH CDR1, VH CDR2, VH CDR3, VL CDR1, VL CDR2, and VL CDR3 amino acid sequences are according to the IMGT numbering system.

B98. The antibody of embodiment B92, wherein the VH CDR1, VH CDR2, VH CDR3, VL CDR1, VL CDR2, and VL CDR3 amino acid sequences are according to the Exemplary numbering system.

B99. The antibody of any one of embodiments B92 to B98, wherein the antibody is
(i) a humanized antibody,
(ii) an IgG antibody, wherein optionally the IgG antibody is an IgG1, IgG2, IgG3, or IgG4 antibody,
(iii) comprises a kappa light chain or a lambda light chain, and/or
(iv) a monoclonal antibody.

B100. The antibody of any one of embodiments B92 to B99, wherein the antibody binds a Vα10.2 antigen.

B101. The antibody of any one of embodiments B92 to B100, wherein antibody binds a Vα10.2 epitope.

B102. The antibody of any one of embodiments B92 to B101, wherein the antibody specifically binds to Vα10.2.

B103. The antibody of any one of embodiments B92 to B102, wherein the VH CDR1, VH CDR2, VH CDR3, VL CDR1, VL CDR2 and VL CDR3 form a binding site for an antigen of the Vα10.2.

B104. The antibody of any one of embodiments B92 to B103, wherein the VH CDR1, VH CDR2, VH CDR3, VL CDR1, VL CDR2 and VL CDR3 form a binding site for an epitope of the Vα10.2.

B105. The antibody of any one of embodiments B92 to B104, wherein the Vα10.2 is present on the surface of a T cell.

B106. The antibody of any one of embodiments B92 to B105, wherein the antibody is multivalent.

B107. The antibody of any one of embodiments B92 to B106, wherein the antibody is a multispecific antibody.

B108. The antibody of any one of embodiments B92 to B107, wherein the antibody is a bispecific antibody.

B109. The antibody of embodiment B107 or B108, wherein the antibody further binds to a second target, wherein the second target is BCMA.

Representative amino acid sequences of antibodies and bispecific antibodies provided herein are shown in the Tables provided in the Examples section and are contemplated as certain embodiments. In addition, representative nucleic acid sequences encoding antibodies provided herein are shown in the Tables provided in the Examples section and are contemplated as certain embodiments. Representative amino acid sequences of antibodies and bispecific antibodies provided herein are also shown in the Sequence Listing and are contemplated as certain embodiments. In addition, representative nucleic acid sequences encoding antibodies provided herein are also shown in Sequence Listing and are contemplated as certain embodiments.

Also provided in the Examples herein are exemplary multi-specific (bispecific) antibodies that bind to Vβ17 and CD123 (also known as IL3RA). CD123 is expressed on a variety of cell types in various tissues, including adipose tissue, adrenal gland, appendix, bone marrow, breast, bronchus, caudate, cerebellum, cerebral cortex, cervix, uterine, colon, duodenum, endometrium, epididymis, esophagus, fallopian tube, gallbladder, heart muscle, hippocampus, kidney, liver, lung, lymph node, nasopharynx, oral mucosa, ovary, pancreas, parathyroid gland, placenta, prostate, rectum, salivary gland, seminal vesicle, skeletal muscle, skin, small intestine, smooth muscle, soft tissue, spleen, stomach, testis, thyroid gland, tonsil, urinary bladder, and vagina (see, e.g., proteinatlas.org). Thus, these Examples are illustrative of exemplary bispecific antibodies that can effectively target a wide variety of cells and tissues in a subject.

In some embodiments, provided herein is a bispecific antibody comprising: (a) a first binding domain that binds to a Vβ17 antigen, and (b) a second binding domain that binds to a second target antigen. In some embodiments, provided herein is a bispecific antibody comprising: (a) a first binding domain that specifically binds to a Vβ17 antigen, and (b) a second binding domain that specifically binds to a second target antigen. In some embodiments, provided herein is a bispecific antibody comprising: (a) a first binding domain that binds to a first epitope on a Vβ17 antigen, and (b) a second binding domain that binds to a second epitope on a second target antigen. In some embodiments, provided herein is a bispecific antibody comprising: (a) a first binding domain that specifically binds to a first epitope on a Vβ17 antigen, and (b) a second binding domain that specifically binds to a second epitope on a second target antigen. In certain embodiments, the second target antigen is CD123.

Exemplary binding agents that bind to Vβ17, as well as exemplary binding agents that bind to CD123 are provided elsewhere herein.

Also provided in the Examples herein are exemplary multi-specific (bispecific) antibodies that bind to Vβ17 and BCMA. These Examples are illustrative of additional exemplary bispecific antibodies that can effectively target a variety of cells and tissues in a subject. In some embodiments, provided herein is a bispecific antibody comprising: (a) a first binding domain that binds to a Vβ17 antigen, and (b) a second binding domain that binds to a second target antigen. In some embodiments, provided herein is a bispecific antibody comprising: (a) a first binding domain that specifically binds to a Vβ17 antigen, and (b) a second binding domain that specifically binds to a second target antigen. In some embodiments, provided herein is a bispecific antibody comprising: (a) a first binding domain that binds to a first epitope on a Vβ17 antigen, and (b) a second binding domain that binds to a second epitope on a second target antigen. In some embodiments, provided herein is a bispecific antibody comprising: (a) a first binding domain that specifically binds to a first epitope on a Vβ17 antigen, and (b) a second binding domain that specifically binds to a second epitope on a second target antigen. In certain embodiments, the second target antigen is BCMA.

Exemplary binding agents that bind to Vβ17, as well as exemplary binding agents that bind to BCMA are provided elsewhere herein.

Also provided in the Examples herein are exemplary multi-specific (bispecific) antibodies that bind to Vβ17 and DLL3. These Examples are illustrative of additional exemplary bispecific antibodies that can effectively target a variety of cells and tissues in a subject. In some embodiments, provided herein is a bispecific antibody comprising: (a) a first binding domain that binds to a Vβ17 antigen, and (b) a second binding domain that binds to a second target antigen. In some embodiments, provided herein is a bispecific antibody comprising: (a) a first binding domain that specifically binds to a Vβ17 antigen, and (b) a second binding domain that specifically binds to a second target antigen. In some embodiments, provided herein is a bispecific antibody comprising: (a) a first binding domain that binds to a first epitope on a Vβ17 antigen, and (b) a second binding domain that binds to a second epitope on a second target antigen. In some embodiments, provided herein is a bispecific antibody comprising: (a) a first binding domain that specifically binds to a first epitope on a Vβ17 antigen, and (b) a second binding domain that specifically binds to a second epitope on a second target antigen. In certain embodiments, the second target antigen is DLL3.

Exemplary binding agents that bind to Vβ17, as well as exemplary binding agents that bind to DLL3 are provided elsewhere herein.

Also provided in the Examples herein are exemplary multi-specific (bispecific) antibodies that bind to Vβ17 and PSMA. These Examples are illustrative of additional exemplary bispecific antibodies that can effectively target a variety of cells and tissues in a subject. In some embodiments, provided herein is a bispecific antibody comprising: (a) a first binding domain that binds to a Vβ17 antigen, and (b) a second binding domain that binds to a second target antigen. In some embodiments, provided herein is a bispecific antibody comprising: (a) a first binding domain that specifically binds to a Vβ17 antigen, and (b) a second binding domain that specifically binds to a second target antigen. In some embodiments, provided herein is a bispecific antibody comprising: (a) a first binding domain that binds to a first epitope on a Vβ17 antigen, and (b) a second binding domain that binds to a second epitope on a second target antigen. In some embodiments, provided herein is a bispecific antibody comprising: (a) a first binding domain that specifically binds to a first epitope on a Vβ17 antigen, and (b) a second binding domain that specifically binds to a second epitope on a second target antigen. In certain embodiments, the second target antigen is PSMA.

Exemplary binding agents that bind to Vβ17, as well as exemplary binding agents that bind to PSMA are provided elsewhere herein.

Also provided in the Examples herein are exemplary multi-specific (bispecific) antibodies that bind to Vβ17 and KLK2. These Examples are illustrative of additional exemplary bispecific antibodies that can effectively target a variety of cells and tissues in a subject. In some embodiments, provided herein is a bispecific antibody comprising: (a) a first binding domain that binds to a Vβ17 antigen, and (b) a second binding domain that binds to a second target antigen. In some embodiments, provided herein is a bispecific antibody comprising: (a) a first binding domain that specifically binds to a Vβ17 antigen, and (b) a second binding domain that specifically binds to a second target antigen. In some embodiments, provided herein is a bispecific antibody comprising: (a) a first binding domain that binds to a first epitope on a Vβ17 antigen, and (b) a second binding domain that binds to a second epitope on a second target antigen. In some embodiments, provided herein is a bispecific antibody comprising: (a) a first binding domain that specifically binds to a first epitope on a Vβ17 antigen, and (b) a second binding domain that specifically binds to a second epitope on a second target antigen. In certain embodiments, the second target antigen is KLK2.

Exemplary binding agents that bind to Vβ17, as well as exemplary binding agents that bind to KLK2 are provided elsewhere herein.

Particular embodiments of this invention are described herein. Upon reading the foregoing description, variations of the disclosed embodiments may become apparent to individuals working in the art, and it is expected that those skilled artisans may employ such variations as appropriate. Accordingly, it is intended that the invention be practiced otherwise than as specifically described herein, and that the invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. A number of embodiments of the invention have been described. Nevertheless, it will be understood that various modifications may be made without departing from the spirit and scope of the invention. Accordingly, the descriptions in the Examples section are intended to illustrate but not limit the scope of invention described in the claims.

EXAMPLES

The following examples are based on the premise that T cells demonstrate potent anti-tumor functions. These cells express TCR-haplotype-Vβ17 and majority of these cells exhibit efficient cytotoxicity of tumor target cells. This ability is then harnessed using bispecific antibodies constructed such that one arm binds to the Vβ17 structure and the other arm binds to an antigen expressed by the cancer cells. Thus, the bispecific antibody bridges the effector and target cells together-resulting in cancer cell killing. This mechanism of action is described in the schematic outlined in FIG. 1.

The subsequent examples can be divided into the following categories: (1) Generation of bispecific antibodies capable of binding to the Vβ17 arm of T-cell receptors (TCR) on CTL (Examples 1 and 2); (2) Evidence for bispecific antibody-enabled target cell killing by CTL expanded in vitro (Example 3); (3) Generation and characterization of bispecific antibodies capable of binding to the Vβ17 arm expressed on αβ T cells and BCMA (Examples 4.1, 4.2, and 4.3); and evidence for bispecific antibody-enabled target cell killing by T cells expanded in vitro (Example 4.4) and (4) Generation and characterization of bispecific antibodies capable of binding to the Vβ17 and DLL3 (Examples 5.1, 5.2, and 5.3); and evidence for bispecific antibody-enabled target cell killing by T cells expanded in vitro (Example 5.4).

Example 1: Human Framework Adaptation of Anti-Vβ17 Mab E17.5F

The mouse IgG1 anti-human T cell receptor Vβ17 clone E17.5F was commercially sourced. Sample preparation and LC/MSMS analysis were performed at Protea Bioscience Inc. (Morgantown, WV). The sample was reduced and alkylated, divided into seven aliquots, and proteolytically digested with Trypsin/LysC, Chymotrypsin, LysC, Pepsin, and AspN, Elastase, and Proteinase K enzymes. Resulting peptides were desalted using a ZipTip C18 Pipette Tips and separated on-line using reverse phase chromatography. Mass spectrometry was performed on Thermo Q-Exactive spectrometer using HCD fragmentation. MS data sets were analyzed using PEAKS software by matching de novo sequence tags to an IMGT-based antibody sequences database. Gaps in the sequence were assigned using Contig sequence assembly of de novo identified peptides. All CDRs and hyper-mutations were confirmed by inspecting the MS/MS spectra The sequences obtained are shown in Tables 1 and 2.

TABLE 1

CDR Sequences of TCR Vβ17 clone E17.5F.

| Anti-body | HCDR1 | SEQ ID NO: | HCDR2 | SEQ ID NO: | HCDR3 | SEQ ID NO: |
|---|---|---|---|---|---|---|
| E17.5F | GYSITSGYFWN | 1 | YISYDGSNN | 2 | PSPGTGYAVDY | 3 |

| Anti-body | LCDR1 | SEQ ID NO: | LCDR2 | SEQ ID NO: | LCDR3 | SEQ ID NO: |
|---|---|---|---|---|---|---|
| E17.5F | RSSQSLVHSNGNTYLH | 4 | KVSNRFS | 5 | SQSTHVPFT | 6 |

TABLE 2

Heavy chain and light chain sequences of TCR Vb17 clone E17.5F.

| mAb ID | Heavy Chain Amino Acid Sequence | SEQ ID NO: |
|---|---|---|
| B17B01 | NVQLQESGPGLVKPSQSLSLTCSVAGYSITSGYFWNWIRQFPGNKLEW MGYISYDGSNNYNPSLKNRISITRDTSKNQFFLKLNSVTTEDTATYYCA SPSPGTGYAVDYWGQGTSVTVSSAKTTPPSVYPLAPGSAAQTNSMVTL GCLVKGYFPEPVTVTWNSGSLSSGVHTFPAVLQSDLYTLSSSVTVPSST WPSQTVTCNVAHPASSTKVDKKIVPRDCGCKPCICTVPEVSSVFIFPPKP KDVLTITLTPKVTCVVVDISKDDPEVQFSWFVDDVEVHTAQTKPREEQ INSTFRSVSELPIMHQDWLNGKEFKCRVNSAAFPAPIEKTISKTYGRPK APQVYTIPPPKEQMAKDKVSLTCMITNFFPEDITVEWQWNGQPAENYK NTQPIMDTDGSYFVYSKLNVQKSNWEAGNTFTCSVLHEGLHNHHTEK SLSHSPGK | 7 |

| | Light Chain Amino Acid Sequence | SEQ ID NO: |
|---|---|---|
| B17B01 | NVVMTQTPLSLPVSLGDQASISCRSSQSLVHSNGNTYLHWYLQKPGQS PKFLIYKVSNRFSGVPDRFSGGGSGTEFTLKISRVEAEDLGVYFCSQSTH VPFTFGSGTKLEIKRADAAPTVSIFPPSSEQLTSGGASVVCFLNNFYPKD INVKWKIDGSERQNGVLNSWTDQDSKDSTYSMSSTLTLTKDEYERHN SYTCEATHKTSTSPIVKSFNRNEC | 8 |

Changes were made in the sequences for the preparation of bispecific antibodies (Table 3). The changes include the following: (1) a framework mutation Asn1 of the heavy chain was not conserved, so the sequence has been modified to have the DVQLW (SEQ ID NO: 968) sequence; (2) another mutation identified in the Fc, K337Y, was deemed uncharacteristic, and, thus, a construct without this mutation was synthesized; and (3) a potential secondary glycosylation site on the heavy chain was observed, and, thus, two versions of this mAb with and without the N-linked site (N82a, based on Chothia numbering) were synthesized.

TABLE 3

Heavy and Light Chain sequences for Vβ17 clone E17.5F antibody variants

| mAb ID | Heavy Chain Amino Acid Sequence | SEQ ID NO: |
|---|---|---|
| B17B1 | NVQLQESGPGLVKPSQSLSLTCSVAGYSITSGYFWNWIRQFPGNKLEWMGYISYDGSNNYNPSLKNRISITRDTSKNQFFLKLNSVTTEDTATYYCASPSPGTGYAVDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK | 9 |
| B17B2 | DVQLKESGPGLVKPSQSLSVTCSVTGYSITSGYYWNWYRQFPGNKLEWMGYISYDGSNNYNPSLKNRISITRDTSKNQILLKLTYVTTEDTATYYCTRPSPGTGYAVDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK | 11 |

| | Light Chain Amino Acid Sequence | SEQ ID NO: |
|---|---|---|
| B17B1 | NVVMTQTPLSLPVSLGDQASISCRSSQSLVHSNGNTYLHWYLQKPGQSPKFLIYKVSNRFSGVPDRFSGGGSGTEFTLKISRVEAEDLGVYFCSQSTHVPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 10 |
| B17B2 | DIVMTQSPDSLAVSLGERATINCRSSQSLVHSNGNTYLHWYQQKPGQPPKLLIYKVSNRFSGVPDRFSGSGSGTDFTLTISSLQAEDVAVYYCSQSTHVPFTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC | 12 |

The two antibodies (B17B1 and B17B2) were expressed in HEK293Expi cells. The supernatants were tested for Vβ17 binding (B17B1 and B17B2) and only B17B1 demonstrated binding. Thus, B17B1 was expressed having an IgG4 constant region with Fc substitutions.

The anti-human TCR Vβ17 mouse mAb B17B1 was humanized using the Human Framework Adaptation (HFA) method (Fransson J, et al. *J. Mol. Biol.* 2010; 398:214-231). To find the best combination of humanized heavy and light chains, several human V-region sequences were selected for testing (Table 4). Selection of human germlines was based solely on the overall sequence similarity to the mouse antibody in the framework (FR) region. Neither the CDR sequences, nor their length or canonical structures, were considered in this selection.

The CDR definition used in HFA is described in (Fransson J, et al. *J. Mol. Biol.* 2010; 398:214-231) and corresponds to the Martin's definition (Abhinandan KR and Martin AC. *Mol. Immunol.* 2008; 45:3832-3839). The CDRs (Table 1) were defined as described below (using the Chothia numbering scheme [Chothia C, and Lesk A. *J. Mol. Biol.* 1987; 196:901-917]):

| | | |
|---|---|---|
| HCDR1 | (SEQ ID NO: 1) | 26-35 |
| HCDR2 | (SEQ ID NO: 2) | 50-58 |
| HCDR3 | (SEQ ID NO: 3) | 95-102 |
| LCDR1 | (SEQ ID NO: 4) | 24-34 |
| LCDR2 | (SEQ ID NO: 5) | 50-56 |
| LCDR3 | (SEQ ID NO: 6) | 89-97 |

The selected human germlines are provided in Table 4 (in the IMGT notation).

TABLE 4

VH and VL variants

| Ab VHSequence | SEQ ID NO: |
|---|---|
| B17H1 NVQLQESGPGLVKPSQSLSLTCSVA<u>GYSITSGYFWN</u>WIRQFPGNKLEWMG<u>YISYDGSNNYNPSLKNRISITRDTS</u>KNQFFLKLNSVTTEDTATYYCAS<u>PSPGTGYAVDY</u>WGQGTSVTVSS | 25 |
| B17H3 EVQLLESGGGLVQPGGSLRLSCAAS<u>GYSITSGYFWN</u>WVRQAPGKGLEWVS<u>YISYDGSNNYADSVKG</u>RFTISRDNSKNTLYLQMNSLRAEDTAVYYCAK<u>PSPGTGYAVDY</u>WGQGTLVTVSS | 19 |
| B17H4 EVQLLESGGGLVQPGGSLRLSCAAS<u>GYSITSGYFWN</u>WVRQAPGKGLEWVS<u>YISYDGSNNYADSVKG</u>RFTISRDNSKNTLYLQMNSLRAEDTAVYYCAS<u>PSPGTGYAVDY</u>WGQGTLVTVSS | 20 |
| B17H5 QVQLQESGPGLVKPSETLSLTCTVS<u>GYSITSGYFWN</u>WIRQPPGKGLEWIG<u>YISYDGSNNYNPSLKSRVT</u>ISRDTSKNQFSLKLSSVTAADTAVYYCAS<u>PSPGTGYAVDY</u>WGQGTLVTVSS | 21 |

| Ab VLSequence | SEQ ID NO: |
|---|---|
| B17L1 NVVMTQTPLSLPVSLGDQASISC<u>RSSQSLVHSNGNTYLH</u>WYLQKPGQSPKFLIY<u>KVSNRFS</u>GVPDRFSGGGSGTEFTLKISRVEAEDLGVYFC<u>SQSTHVPFT</u>FGSGTKLEIK | 26 |
| B17L3 DIQMTQSPSSLSASVGDRVTITC<u>RSSQSLVHSNGNTYLH</u>WYQQKPGKAPKLLIY<u>KVSNRFS</u>GVPSRFSGSGSGTDFTLTISSLQPEDFATYYC<u>SQSTHVPFT</u>FGQGTKLEIK | 22 |
| B17L4 DIQMTQSPSSLSASVGDRVTITC<u>RSSQSLVHSNGNTYLH</u>WYQQKPGKAPKFLIY<u>KVSNRFS</u>GVPSRFSGSGSGTDFTLTISSLQPEDFATYYC<u>SQSTHVPFT</u>FGQGTKLEIK | 23 |
| B17L5 DVVMTQSPLSLPVTLGQPASISC<u>RSSQSLVHSNGNTYLH</u>WFQQRPGQSPRFLIY<u>KVSNRFS</u>GVPDRFSGSGSGTDFTLKISRVEAEDVGVYYC<u>SQSTHVPFT</u>FGQGTKLEIK | 24 |

CDRs1-3 are underlined

"Back mutations" in several variants were introduced at FR positions that are known to be important for VL/VH pairing and CDR conformation. The selected human germlines are provided in Table 5 (in the IMGT notation), with the back mutations noted.

TABLE 5

The selected J-regions

| J-region | Sequence | SEQ ID NO: |
|---|---|---|
| IGHJ1*01 HC | WGQGTLVTVSS | 42 |
| IGKJ2*01 LC | FGQGTKLEIK | 43 |

Amino acid sequences of all nine pairwise combinations of three heavy chains and three light chains were back-translated to DNA, and cDNA was prepared using gene synthesis techniques (U.S. Pat. Nos. 6,670,127; 6,521,427). Heavy chain (HC) variable regions were subcloned onto human IgG4 constant region using an in-house expression vector with the CMV promoter using standard molecular biology techniques. Light chain (LC) variable regions were subcloned onto a human Lambda (λ) constant regions using an in-house expression vector with the CMV promoter using standard molecular biology techniques. Resulting plasmids were transfected into HEK EXPI cells (LifeTechnologies; Carlsbad, CA) and mAbs were expressed. Purification was by standard methods using a Protein A column (HITRAP MAB SELECT SURE column). After elution, the pools were dialyzed into D-PBS, pH 7.2.

TABLE 6

Heavy and Light chains of nine humanized Vβ17 antibodies

| mAb | Hc | SEQ ID NO: | Lc | SEQ ID NO: | Concentration (µg/mL) |
|---|---|---|---|---|---|
| B17B14 | B17H3 | 19 | B17L3 | 22 | 686.3 |
| B17B15 | B17H3 | 19 | B17L4 | 23 | 13.8 |
| B17B16 | B17H3 | 19 | B17L5 | 24 | 14.6 |
| B17B17 | B17H4 | 20 | B17L3 | 22 | 335.1 |
| B17B18 | B17H4 | 20 | B17L4 | 23 | 45.2 |
| B17B19 | B17H4 | 20 | B17L5 | 24 | 27.5 |
| B17B20 | B17H5 | 21 | B17L3 | 22 | 602.1 |
| B17B21 | B17H5 | 21 | B17L4 | 23 | 570.9 |
| B17B22 | B17H5 | 21 | B17L5 | 24 | 320.5 |

The humanized antibodies were screened for binding to a TCRVβ17 (SEQ ID NO:27)/Vα10.2-Fc (SEQ ID NO:44) fusion protein by ELISA. Biotinylated TCRVβ17/Vα10.2-Fc fusion protein was added to a streptavidin-coated ELISA plate. Unbound protein was washed away and mAb was added at a range of concentrations (0.01-10 µg/mL). Plates were washed and anti-kappa:HRP detection antibody was added. Plates were washed, chemiluminescent detection reagent was added, and the plates were read on a Perkin Elmer ENVISION plate reader for luminescence. B17B20 and B17B21 showed positive binding to the TCR-Vβ17 protein. B17B22 showed weak binding to this protein. These antibodies were then purified as described above for further studies. B17B21 demonstrated the best binding to recombinant TCR-Vβ17 protein and to M1-stimulated T-cells and was thus chosen as the molecule for further functional studies, specifically T-cell re-directed cancer cell killing as a bispecific antibody.

Thus, the variable region sequence of B17B21 (anti-Vβ17) and I3RB217 (anti-CD123 antibody) was used to generate a bispecific antibody to be tested for T-cell re-directed killing of acute myeloid leukemia (AML) cells.

Example 2. Preparation of Anti-Vb17/Anti-CD123 Bispecific Antibodies

VB11 (anti-Vβ17/anti-CD123) and VB13 (Vβ17×Null) bispecific antibodies were produced as full-length antibodies in the knob-into-hole format as human IgG4, as previously described (Atwell et al. J. Mol. Biol. 270: 26-35, 1997). Nucleic acid sequences encoding variable regions were subcloned into a custom mammalian expression vectors containing constant region of IgG4 expression cassettes using standard PCR restriction enzyme based cloning techniques. The bispecific antibodies were expressed by transient transfection in Chinese hamster ovary cell line. The antibodies were initially purified by MabSelect SuRe Protein A column (GE healthcare, Piscataway, New Jersey) (Brown, Bottomley et al. 1998). The column was equilibrated with Phosphate Buffer Saline (PBS), pH 7.2 and loaded with fermentation supernatant at a flow rate of 2 mL/min. After loading, the column was washed with PBS (4 CV) followed by elution in 30 mM sodium acetate, pH 3.5. Fractions containing protein peaks as monitored by Absorbance at 280 nm in AKTA Explorer (GE healthcare) were pooled together and were neutralized to pH 5.0 by adding 1% of 3M sodium acetate, pH 9.0. As a polishing step, the antibodies were purified on a preparative size exclusion chromatography (SEC) using a SUPERDEX 200 column (GE healthcare). The integrity of the sample was assessed by endotoxin measurement and SDS polyacrylamide gel electrophoresis under reducing and non-reducing conditions. The final protein concentrations were 0.48 mg/ml for anti-Vβ17/anti-CD123 and 0.24 mg/mL for Vβ17×Null. The final EU levels of anti-Vβ17/anti-CD123 and Vβ17×Null based on these protein concentrations were 2.053 EU/mg and 4.219 EU/mg, respectively.

TABLE 7

Sequences of half antibodies expressed in CHO cells

| mAb ID | 'Knob' arm and 'hole' arm amino acid sequence | SEQ ID NO: |
|---|---|---|
| B17B21 (Vβ17 half Ab) | MAWVWTLLFLMAAAQSIQADIQMTQSPSSLSASVGDRVTITCRSSQSLVHSNGNTY LHWYQQKPGKAPKFLIYKVSNRFSGVPSRFSGSGSGTDFTLTISSLQPEDFATYYC SQSTHVPFTFGQGTKLEIKRTVAAPSVFIFPPSDEQLKSGTASVVCLLNNFYPREA KVQWKVDNALQSGNSQESVTEQDSKDSTYSLSSTLTLSKADYEKHKVYACEVTHQG LSSPVTKSFNRGECGGSEGKSSGSGSESKSTEGKSSGSGSESKSTGGSQVQLQESG PGLVKPSETLSLTCTVSGYSITSGYFWNWIRQPPGKGLEWIGYISYDGSNNYNPSL KSRVTISRDTSKNQFSLKLSSVTAADTAVYYCASPSPGTGYAVDYWGQGTLVTVSS ASTKGPSVFPLAPCSRSTSESTAALGCLVKDYFPEPVTVSWNSGALTSGVHTFPAV LQSSGLYSLSSVVTVPSSSLGTKTYTCNVDHKPSNTKVDKRVESKYGPPCPPCPAP EAAGGPSVFLFPPKPKDTLMISRTPEVTCVVVDVSQEDPEVQFNWYVDGVEVHNAK TKPREEQFNSTYRVVSVLTVLHQDWLNGKEYKCKVSNKGLPSSIEKTISKAKGQPR EPQVYTLPPSQEEMTKNQVSLSCAVKGFYPSDIAVEWESNGQPENNYKTTPPVLDS DGSFFLVSRLTVDKSRWQEGNVFSCSVMHEALHNRFTQKSLSLSLGK | 28 |
| I3RB217 (CD123 half Ab) | MAWVWTLLFLMAAAQSIQAEIVLTQSPGTLSLSPGERATLSCRASQSVSSSYLAWY QQKPGQAPRLLIYGASSRATGIPDRFSGSGSGTDFTLTISRLEPEDFAVYYCQQDY GFPWTFGQGTKVEIKRTVAAPSVFIFPPSDEQLKSGTASVVCLLNNFYPREAKVQW KVDNALQSGNSQESVTEQDSKDSTYSLSSTLTLSKADYEKHKVYACEVTHQGLSSP VTKSFNRGECGGSEGKSSGSGSESKSTEGKSSGSGSESKSTGGSEVQLVQSGAEVK KPGESLKISCKGSGYSFTSYWISWVRQMPGKGLEWMGIIDPSDSDTRYSPSFQGQV TISADKSISTAYLQWSSLKASDTAMYYCARGDGSTDLDYWGQGTLVTVSSASTKGP SVFPLAPCSRSTSESTAALGCLVKDYFPEPVTVSWNSGALTSGVHTFPAVLQSSGL YSLSSVVTVPSSSLGTKTYTCNVDHKPSNTKVDKRVESKYGPPCPPCPAPEAAGGP SVFLFPPKPKDTLMISRTPEVTCVVVDVSQEDPEVQFNWYVDGVEVHNAKTKPREE QFNSTYRVVSVLTVLHQDWLNGKEYKCKVSNKGLPSSIEKTISKAKGQPREPQVYT LPPSQEEMTKNQVSLWCLVKGFYPSDIAVEWESNGQPENNYKTTPPVLDSDGSFFL YSRLTVDKSRWQEGNVFSCSVMHEALHNHYTQKSLSLSLGK | 30 |
| B23B49 (Null half Ab) | MAWVWTLLFLMAAAQSIQAEIVLTQSPGTLSLSPGERATLSCRASQSVSSSYLAWY QQKPGQAPRLLIYGASSRATGIPDRFSGSGSGTDFTLTISRLEPEDFAVYYCQQDY GFPWTFGQGTKVEIKRTVAAPSVFIFPPSDEQLKSGTASVVCLLNNFYPREAKVQW KVDNALQSGNSQESVTEQDSKDSTYSLSSTLTLSKADYEKHKVYACEVTHQGLSSP VTKSFNRGECGGSEGKSSGSGSESKSTEGKSSGSGSESKSTGGSEVQLVQSGAEVK KPGESLKISCKGSGYSFTSYWISWVRQMPGKGLEWMGIIDPSDSDTRYSPSFQGQV TISADKSISTAYLQWSSLKASDTAMYYCARGDGSTDLDYWGQGTLVTVSSASTKGP SVFPLAPCSRSTSESTAALGCLVKDYFPEPVTVSWNSGALTSGVHTFPAVLQSSGL YSLSSVVTVPSSSLGTKTYTCNVDHKPSNTKVDKRVESKYGPPCPPCPAPEAAGGP SVFLFPPKPKDTLMISRTPEVTCVVVDVSQEDPEVQFNWYVDGVEVHNAKTKPREE QFNSTYRVVSVLTVLHQDWLNGKEYKCKVSNKGLPSSIEKTISKAKGQPREPQVYT LPPSQEEMTKNQVSLWCLVKGFYPSDIAVEWESNGQPENNYKTTPPVLDSDGSFFL YSRLTVDKSRWQEGNVFSCSVMHEALHNHYTQKSLSLSLGK | 30 |

TABLE 7-continued

Sequences of half antibodies expressed in CHO cells

| mAb ID | 'Knob' arm and 'hole' arm amino acid sequence | SEQ ID NO: |
|---|---|---|
| | Half Antibody DNA sequence | |
| B17B21 (Vβ17 half Ab) | ATGGCCTGGGTGTGGACCCTGCTGTTCCTGATGGCCGCCGCCCAGAGCATCCAGGC CGACATCCAGATGACCCAGAGCCCAAGCAGCCTGAGCGCCAGCGTGGGCGACCGCG TGACCATCACCTGCCGCAGCAGCCAGAGCCTGGTGCACAGCAACGGCAACACCTAC CTGCACTGGTACCAGCAGAAGCCAGGCAAGGCCCCAAAGTTCCTGATCTACAAGGT GAGCAACCGCTTCAGCGGCGTGCCAAGCCGCTTCAGCGGCAGCGGCAGCGGCACCG ACTTCACCCTGACCATCAGCAGCCTGCAGCCAGAGGACTTCGCCACCTACTACTGC AGCCAGAGCACCCACGTGCCATTCACCTTCGGCCAGGGCACCAAGCTGGAGATCAA GCGCACCGTGGCCGCCCCAAGCGTGTTCATCTTCCCACCAAGCGACGAGCAGCTGA AGAGCGGCACCGCCAGCGTGGTGTGCCTGCTGAACAACTTCTACCCACGCGAGGCC AAGGTGCAGTGGAAGGTGGACAACGCCCTGCAGAGCGGCAACAGCCAGGAGAGCGT GACCGAGCAGGACAGCAAGGACAGCACCTACAGCCTGAGCAGCACCCTGACCCTGA GCAAGGCCGACTACGAGAAGCACAAGGTGTACGCCTGCGAGGTGACCCACCAGGGC CTGAGCAGCCCAGTGACCAAGAGCTTCAACCGCGGCGAGTGCGGCGGCAGCGAGGG CAAGAGCAGCGGCAGCGGCAGCGAGAGCAAGAGCACCGAGGGCAAGAGCAGCGGCA GCGGCAGCGAGAGCAAGAGCACCGGCGGCAGCCAGGTGCAGCTGCAGGAGAGCGGC CCAGGCCTGGTGAAGCCAAGCGAGACCCTGAGCCTGACCTGCACCGTGAGCGGCTA CAGCATCACCAGCGGCTACTTCTGGAACTGGATCCGCCAGCCACCAGGCAAGGGCC TGGAGTGGATCGGCTACATCAGCTACGACGGCAGCAACAACTACAACCCAAGCCTG AAGAGCCGCGTGACCATCAGCCGCGACACCAGCAAGAACCAGTTCAGCCTGAAGCT GAGCAGCGTGACCGCCGCCGACACCGCCGTGTACTACTGCGCCAGCCCAAGCCCGA GCACCGGCTACGCCGTGGACTACTGGGGCCAGGGCACCCTGGTGACCGTGAGCAGC GCCAGCACCAAGGGCCCAAGCGTGTTCCCACTGGCCCCATGCAGCCGCAGCACCAG CGAGAGCACCGCCGCCCTGGGCTGCCTGGTGAAGGACTACTTCCCAGAGCCAGTGA CCGTGAGCTGGAACAGCGGCGCCCTGACCAGCGGCGTGCACACCTTCCCAGCCGTG CTGCAGAGCAGCGGCCTGTACAGCCTGAGCAGCGTGGTGACCGTGCCAAGCAGCAG CCTGGGCACCAAGACCTACACCTGCAACGTGGACCACAAGCCAAGCAACACCAAGG TGGACAAGCGCGTGGAGAGCAAGTACGGCCCACCATGCCCACCATGCCCAGCCCCA GAGGCCGCCGGCGGCCCAAGCGTGTTCCTGTTCCCACCAAAGCCAAAGGACACCCT GATGATCAGCCGCACCCCAGAGGTGACCTGCGTGGTGGTGGACGTGAGCCAGGAGG ACCCAGAGGTGCAGTTCAACTGGTACGTGGACGGCGTGGAGGTGCACAACGCCAAG ACCAAGCCACGCGAGGAGCAGTTCAACAGCACCTACCGCGTGGTGAGCGTGCTGAC CGTGCTGCACCAGGACTGGCTGAACGGCAAGGAGTACAAGTGCAAGGTGAGCAACA AGGGCCTGCCAAGCAGCATCGAGAAGACCATCAGCAAGGCCAAGGGCCAGCCAGCC GAGCCACAGGTGTACACCCTGCCACCAAGCCAGGAGGAGATGACCAAGAACCAGGT GAGCCTGAGCTGCGCCGTGAAGGGCTTCTACCCAAGCGACATCGCCGTGGAGTGGG AGAGCAACGGCCAGCCAGAGAACAACTACAAGACCACCCCACCAGTGCTGGACAGC GACGGCAGCTTCTTCCTGGTGAGCCGCCTGACCGTGGACAAGAGCCGCTGGCAGGA GGGCAACGTGTTCAGCTGCAGCGTGATGCACGAGGCCCTGCACAACCGCTTCACCC AGAAGAGCCTGAGCCTGAGCCCTGGGCAAGATGGCCTGGGTGTGGACCCTGCTGTTC CTGATGGCCGCCGCCCAGAGCATCCAGGCCGACATCCAGATGACCCAGAGCCCAAG CAGCCTGAGCGCCAGCGTGGGCGACCGCGTGACCATCACCTGCCGCAGCAGCCAGA GCCTGGTGCACAGCAACGGCAACACCTACCTGCACTGGTACCAGCAGAAGCCAGGC AAGGCCCCAAAGTTCCTGATCTACAAGGTGAGCAACCGCTTCAGCGGCGTGCCAAG CCGCTTCAGCGGCAGCGGCAGCGGCACCGACTTCACCCTGACCATCAGCAGCCTGC AGCCAGAGGACTTCGCCACCTACTACTGCAGCCAGAGCACCCACGTGCCATTCACC TTCGGCCAGGGCACCAAGCTGGAGATCAAGCGCACCGTGGCCGCCCCAAGCGTGTT CATCTTCCCACCAAGCGACGAGCAGCTGAAGAGCGGCACCGCCAGCGTGGTGTGCC TGCTGAACAACTTCTACCCACGCGAGGCCAAGGTGCAGTGGAAGGTGGACAACGCC CTGCAGAGCGGCAACAGCCAGGAGAGCGTGACCGAGCAGGACAGCAAGGACAGCAC CTACAGCCTGAGCAGCACCCTGACCCTGAGCAAGGCCGACTACGAGAAGCACAAGG TGTACGCCTGCGAGGTGACCCACCAGGGCCTGAGCAGCCCAGTGACCAAGAGCTTC AACCGCGGCGAGTGCGGCGGCAGCGAGGGCAAGAGCAGCGGCAGCGGCAGCGAGAG CAAGAGCACCGAGGGCAAGAGCAGCGGCAGCGGCAGCGAGAGCAAGAGCACCGGCG GCAGCCAGGTGCAGCTGCAGGAGAGCGGCCCAGGCCTGGTGAAGCCAAGCGAGACC CTGAGCCTGACCTGCACCGTGAGCGGCTACAGCATCACCAGCGGCTACTTCTGGAA CTGGATCCGCCAGCCACCAGGCAAGGGCCTGGAGTGGATCGGCTACATCAGCTACG ACGGCAGCAACAACTACAACCCAAGCCTGAAGAGCCGCGTGACCATCAGCCGCGAC ACCAGCAAGAACCAGTTCAGCCTGAAGCTGAGCAGCGTGACCGCCGCCGACACCGC CGTGTACTACTGCGCCAGCCCAAGCCCAGGCACCGGCTACGCCGTGGACTACTGGG GCCAGGGCACCCTGGTGACCGTGAGCAGCGCCAGCACCAAGGGCCCAAGCGTGTTC CCACTGGCCCCATGCAGCCGCAGCACCAGCGAGAGCACCGCCGCCCTGGGCTGCCT GGTGAAGGACTACTTCCCAGAGCCAGTGACCGTGAGCTGGAACAGCGGCGCCCTGA CCAGCGGCGTGCACACCTTCCCAGCCGTGCTGCAGAGCAGCGGCCTGTACAGCCTG AGCAGCGTGGTGACCGTGCCAAGCAGCAGCCTGGGCACCAAGACCTACACCTGCAA CGTGGACCACAAGCCAAGCAACACCAAGGTGGACAAGCGCGTGGAGAGCAAGTACG GCCCACCATGCCCACCATGCCCAGCCCCAGAGGCCGCCGGCGGCCCAAGCGTGTTC CTGTTCCCACCAAAGCCAAAGGACACCCTGATGATCAGCCGCACCCCAGAGGTGAC CTGCGTGGTGGTGGACGTGAGCCAGGAGGACCCAGAGGTGCAGTTCAACTGGTACG TGGACGGCGTGGAGGTGCACAACGCCAAGACCAAGCCACGCGAGGAGCAGTTCAAC AGCACCTACCGCGTGGTGAGCGTGCTGACCGTGCTGCACCAGGACTGGCTGAACGG CAAGGAGTACAAGTGCAAGGTGAGCAACAAGGGCCTGCCAAGCAGCATCGAGAAGA | 29 |

TABLE 7-continued

Sequences of half antibodies expressed in CHO cells

| mAb ID | 'Knob' arm and 'hole' arm amino acid sequence | SEQ ID NO: |
|---|---|---|
| | CCATCAGCAAGGCCAAGGGCCAGCCACGCGAGCCACAGGTGTACACCCTGCCACCA AGCCAGGAGGAGATGACCAAGAACCAGGTGAGCCTGAGCTGCGCCGTGAAGGGCTT CTACCCCAAGCGACATCGCCGTGGAGTGGGAGAGCAACGGCCAGCCAGAGAACAACT ACAAGACCACCCCACCAGTGCTGGACAGCGACGGCAGCTTCTTCCTGGTGAGCCGC CTGACCGTGGACAAGAGCCGCTGGCAGGAGGGCAACGTGTTCAGCTGCAGCGTGAT GCACGAGGCCCTGCACAACCGCTTCACCCAGAAGAGCCTGAGCCTGAGCCTGGGCA AGTGATAG | |
| I3RB217 (CD123 half Ab) | ATGGCCTGGGTGTGGACCCTGCTGTTCCTGATGGCCGCCGCCCAGAGCATCCAGGC CGAGATCGTGCTGACCCAGAGCCCAGGCACCCTGAGCCTGAGCCCAGGCGAGCGCG CCACCCTGAGCTGCCGCGCCAGCCAGAGCGTGAGCAGCAGCTACCTGGCCTGGTAC CAGCAGAAGCCAGGCCAGGCCCCACGCCTGCTGATCTACGGCGCCAGCAGCCGCGC CACCGGCATCCCAGACCGCTTCAGCGGCAGCGGCAGCGGCACCGACTTCACCCTGA CCATCAGCCGCCTGGAGCCAGAGGACTTCGCCGTGTACTACTGCCAGCAGGACTAC GGCTTCCCATGGACCTTCGGCCAGGGCACCAAGGTGGAGATCAAGCGCACCGTGGC CGCCCCAAGCGTGTTCATCTTCCCACCAAGCGACGAGCAGCTGAAGAGCGGCACCG CCAGCGTGGTGTGCCTGCTGAACAACTTCTACCCACGCGAGGCCAAGGTGCAGTGG AAGGTGGACAACGCCCTGCAGAGCGGCAACAGCCAGGAGAGCGTGACCGAGCAGGA CAGCAAGGACAGCACCTACAGCCTGAGCAGCACCCTGACCCTGAGCAAGGCCGACT ACGAGAAGCACAAGGTGTACGCCTGCGAGGTGACCCACCAGGGCCTGAGCAGCCCA GTGACCAAGAGCTTCAACCGCGGCGAGTGCggcggcagcgagggcaagagcagcgg cagcggcagcgagagcaagagcaccgagggcaagagcagcggcagcggcagcgaga gcaagagcaccggcggcagcGAGGTGCAGCTGGTGCAGAGCGGCGCCGAGGTGAAG AAGCCAGGCGAGAGCCTGAAGATCAGCTGCAAGGGCAGCGGCTACAGCTTCACCAG CTACTGGATCAGCTGGGTGCGCCAGATGCCAGGCAAGGGCCTGGAGTGGATGGGCA TCATCGACCCAAGCGACAGCGACACCCGCTACAGCCCAAGCTTCCAGGGCCAGGTG ACCATCAGCGCCGACAAGAGCATCAGCACCGCCTACCTGCAGTGGAGCAGCCTGAA GGCCAGCGACACCGCCATGTACTACTGCGCCCGCGGCGACGGCAGCACCGACCTGG ACTACTGGGGCCAGGGCACCCTGGTGACCGTGAGCAGCGCCAGCACCAAGGGCCCA AGCGTGTTCCCACTGGCCCCATGCAGCCGCAGCACCAGCGAGAGCACCGCCGCCCT GGGCTGCCTGGTGAAGGACTACTTCCCAGAGCCAGTGACCGTGAGCTGGAACAGCG GCGCCCTGACCAGCGGCGTGCACACCTTCCCAGCCGTGCTGCAGAGCAGCGGCCTG TACAGCCTGAGCAGCGTGGTGACCGTGCCAAGCAGCAGCCTGGGCACCAAGACCTA CACCTGCAACGTGGACCACAAGCCAAGCAACACCAAGGTGGACAAGCGCGTGGAGA GCAAGTACGGCCCACCATGCCCACCATGCCCAGCCCCAGAGGCCGCCGGCGGCCCA AGCGTGTTCCTGTTCCCACCAAAGCCAAAGGACACCCTGATGATCAGCCGCACCCC AGAGGTGACCTGCGTGGTGGTGGACGTGAGCCAGGAGGACCCAGAGGTGCAGTTCA ACTGGTACGTGGACGGCGTGGAGGTGCACAACGCCAAGACCAAGCCACGCGAGGAG CAGTTCAACAGCACCTACCGCGTGGTGAGCGTGCTGACCGTGCTGCACCAGGACTG GCTGAACGGCAAGGAGTACAAGTGCAAGGTGAGCAACAAGGGCCTGCCAAGCAGCA TCGAGAAGACCATCAGCAAGGCCAAGGGCCAGCCACGCGAGCCACAGGTGTACACC CTGCCACCAAGCCAGGAGGAGATGACCAAGAACCAGGTGAGCCTGTGGTGCCTGGT GAAGGGCTTCTACCCAAGCGACATCGCCGTGGAGTGGGAGAGCAACGGCCAGCCAG AGAACAACTACAAGACCACCCCACCAGTGCTGGACAGCGACGGCAGCTTCTTCCTG TACAGCCGCCTGACCGTGGACAAGAGCCGCTGGCAGGAGGGCAACGTGTTCAGCTG CAGCGTGATGCACGAGGCCCTGCACAACCACTACACCCAGAAGAGCCTGAGCCTGA GCCTGGGCAAG | 31 |
| B23B49 (Null half Ab) | ATGGCCTGGGTGTGGACCCTGCTGTTCCTGATGGCCGCCGCCCAGAGCATCCAGGC CGACATCGTGATGACCCAGAGCCCAGACAGCCTGGCCGTGAGCCTGGGCGAGCGCG CCACCATCAACTGCCGCGCCAGCCAGAGCGTGGACTACAACGGCATCAGCTACATG CACTGGTACCAGCAGAAGCCAGGCCAGCCACCAAAGCTGCTGATCTACGCCGCCAG CAACCCAGAGAGCGGCGTGCCAGACCGCTTCAGCGGCAGCGGCAGCGGCACCGACT TCACCCTGACCATCAGCAGCCTGCAGGCCGAGGACGTGGCCGTGTACTACTGCCAG CAGATCATCGAGGACCCATGGACCTTCGGCCAGGGCACCAAGGTGGAGATCAAGCG CACCGTGGCCGCCCCAAGCGTGTTCATCTTCCCACCAAGCGACGAGCAGCTGAAGA GCGGCACCGCCAGCGTGGTGTGCCTGCTGAACAACTTCTACCCACGCGAGGCCAAG GTGCAGTGGAAGGTGGACAACGCCCTGCAGAGCGGCAACAGCCAGGAGAGCGTGAC CGAGCAGGACAGCAAGGACAGCACCTACAGCCTGAGCAGCACCCTGACCCTGAGCA AGGCCGACTACGAGAAGCACAAGGTGTACGCCTGCGAGGTGACCCACCAGGGCCTG AGCAGCCCAGTGACCAAGAGCTTCAACCGCGGCGAGTGCGGCGGCAGCGAGGGCAA GAGCAGCGGCAGCGGCAGCGAGAGCAAGAGCACCGAGGGCAAGAGCAGCGGCAGCG GCAGCGAGAGCAAGAGCACCGGCGGCAGCCAGATCACCCTGAAGGAGAGCGGCCCA ACCCTGGTGAAGCCAACCCAGACCCTGACCCTGACCTGCACCTTCAGCGGCTTCAG CCTGAGCACCAGCGGCATGGGCGTGAGCTGGATCCGCCAGCCACCAGGCAAGGCCC TGGAGTGGCTGGCCCACATCTACTGGGACGACGACAAGCGCTACAACCCAAGCCTG AAGAGCCGCCTGACCATCACCAAGGACACCAGCAAGAACCAGGTGGTGCTGACCAT GACCAACATGGACCCAGTGGACACCGCCACCTACTACTGCGCCCGCCTGTACGGCT TCACCTACGGCTTCGCCTACTGGGGCCAGGGCACCCTGGTGACCGTGAGCAGCGCC AGCACCAAGGGCCCAAGCGTGTTCCCACTGGCCCCATGCAGCCGCAGCACCAGCGA GAGCACCGCCGCCCTGGGCTGCCTGGTGAAGGACTACTTCCCAGAGCCAGTGACCG TGAGCTGGAACAGCGGCGCCCTGACCAGCGGCGTGCACACCTTCCCAGCCGTGCTG CAGAGCAGCGGCCTGTACAGCCTGAGCAGCGTGGTGACCGTGCCAAGCAGCAGCCT GGGCACCAAGACCTACACCTGCAACGTGGACCACAAGCCAAGCAACACCAAGGTGG | 969 |

TABLE 7-continued

Sequences of half antibodies expressed in CHO cells

| mAb ID | 'Knob' arm and 'hole' arm amino acid sequence | SEQ ID NO: |
|---|---|---|
| | ACAAGCGCGTGGAGAGCAAGTACGGCCCCACCATGCCCACCATGCCCAGCCCCAGAG | |
| | GCCGCCGGCGGCCCAAGCGTGTTCCTGTTCCCACCAAAGCCAAAGGACACCCTGAT | |
| | GATCAGCCGCACCCCAGAGGTGACCTGCGTGGTGGTGGACGTGAGCCAGGAGGACC | |
| | CAGAGGTGCAGTTCAACTGGTACGTGGACGGCGTGGAGGTGCACAACGCCAAGACC | |
| | AAGCCACGCGAGGAGCAGTTCAACAGCACCTACCGCGTGGTGAGCGTGCTGACCGT | |
| | GCTGCACCAGGACTGGCTGAACGGCAAGGAGTACAAGTGCAAGGTGAGCAACAAGG | |
| | GCCTGCCAAGCAGCATCGAGAAGACCATCAGCAAGGCCAAGGGCCAGCCACGCGAG | |
| | CCACAGGTGTACACCCTGCCACCAAGCCAGGAGGAGATGACCAAGAACCAGGTGAG | |
| | CCTGTGGTGCCTGGTGAAGGGCTTCTACCCAAGCGACATCGCCGTGGAGTGGGAGA | |
| | GCAACGGCCAGCCAGAGAACAACTACAAGACCACCCCACCAGTGCTGGACAGCGAC | |
| | GGCAGCTTCTTCCTGTACAGCCGCCTGACCGTGGACAAGAGCCGCTGGCAGGAGGG | |
| | CAACGTGTTCAGCTGCAGCGTGATGCACGAGGCCCTGCACAACCACTACACCCAGA | |
| | GAGAGCCTGAGCCTGAGCCTGGGCAAG | |

TABLE 8

Heavy and Light Chain Sequences for Vβ17 bispecific antibodies

| Bispecific Antibody | | Amino Acid Sequence |
|---|---|---|
| Anti-Vβ17/ anti-CD123 | Heavy chain 1 B17B21 (SEQ ID NO: 13) | QVQLQESGPGLVKPSETLSLTCTVSGYSITSGYFWNWIRQPPGKG LEWIGYISYDGSNNYNPSLKSRVTISRDTSKNQFSLKLSSVTAAD TAVYYCASPSPGTGYAVDYWGQGTLVTVSSASTKGPSVFPLAPCS RSTSESTAALGCLVKDYFPEPVTVSWNSGALTSGVHTFPAVLQSS GLYSLSSVVTVPSSSLGTKTYTCNVDHKPSNTKVDKRVESKYGPP CPPCPAPEAAGGPSVFLFPPKPKDTLMISRTPEVTCVVVDVSQED PEVQFNWYVDGVEVHNAKTKPREEQFNSTYRVVSVLTVLHQDWLN GKEYKCKVSNKGLPSSIEKTISKAKGQPREPQVYTLPPSQEEMTK NQVSLSCAVKGFYPSDIAVEWESNGQPENNYKTTPPVLDSDGSFF LVSRLTVDKSRWQEGNVFSCSVMHEALHNRFTQKSLSLSLGK |
| | Light Chain 1 B17B21 (SEQ ID NO: 14) | DIQMTQSPSSLSASVGDRVTITCRSSQSLVHSNGNTYLHWYQQKP GKAPKFLIYKVSNRFSGVPSRFSGSGSGTDFTLTISSLQPEDFAT YYCSQSTHVPFTFGQGTKLEIKRTVAAPSVFIFPPSDEQLKSGTA SVVCLLNNFYPREAKVQWKVDNALQSGNSQESVTEQDSKDSTYSL SSTLTLSKADYEKHKVYACEVTHQGLSSPVTKSFNRGEC |
| | Heavy chain 2 I3RB217 (SEQ ID NO: 15) | EVQLVQSGAEVKKPGESLKISCKGSGYSFTSYWISWVRQMPGKGL EWMGIIDPSDSDTRYSPSFQGQVTISADKSISTAYLQWSSLKASD TAMYYCARGDGSTDLDYWGQGTLVTVSSASTKGPSVFPLAPCSRS TSESTAALGCLVKDYFPEPVTVSWNSGALTSGVHTFPAVLQSSGL YSLSSVVTVPSSSLGTKTYTCNVDHKPSNTKVDKRVESKYGPPCP PCPAPEAAGGPSVFLFPPKPKDTLMISRTPEVTCVVVDVSQEDPE VQFNWYVDGVEVHNAKTKPREEQFNSTYRVVSVLTVLHQDWLNGK EYKCKVSNKGLPSSIEKTISKAKGQPREPQVYTLPPSQEEMTKNQ VSLWCLVKGFYPSDIAVEWESNGQPENNYKTTPPVLDSDGSFFLY SRLTVDKSRWQEGNVFSCSVMHEALHNHYTQKSLSLSLGK |
| | Light Chain 2 I3RB217 (SEQ ID NO: 16) | EIVLTQSPGTLSLSPGERATLSCRASQSVSSSYLAWYQQKPGQAP RLLIYGASSRATGIPDRFSGSGSGTDFTLTISRLEPEDFAVYYCQ QDYGFPWTFGQGTKVEIKRTVAAPSVFIFPPSDEQLKSGTASVVC LLNNFYPREAKVQWKVDNALQSGNSQESVTEQDSKDSTYSLSSTL TLSKADYEKHKVYACEVTHQGLSSPVTKSFNRGEC |
| Vβ17 x Null | Heavy chain 1 B17B21 (SEQ ID NO: 13) | QVQLQESGPGLVKPSETLSLTCTVSGYSITSGYFWNWIRQPPGKG LEWIGYISYDGSNNYNPSLKSRVTISRDTSKNQFSLKLSSVTAAD TAVYYCASPSPGTGYAVDYWGQGTLVTVSSASTKGPSVFPLAPCS RSTSESTAALGCLVKDYFPEPVTVSWNSGALTSGVHTFPAVLQSS GLYSLSSVVTVPSSSLGTKTYTCNVDHKPSNTKVDKRVESKYGPP CPPCPAPEAAGGPSVFLFPPKPKDTLMISRTPEVTCVVVDVSQED PEVQFNWYVDGVEVHNAKTKPREEQFNSTYRVVSVLTVLHQDWLN GKEYKCKVSNKGLPSSIEKTISKAKGQPREPQVYTLPPSQEEMTK NQVSLSCAVKGFYPSDIAVEWESNGQPENNYKTTPPVLDSDGSFF LVSRLTVDKSRWQEGNVFSCSVMHEALHNRFTQKSLSLSLGK |
| | Light Chain 1 B17B21 (SEQ ID NO: 14) | DIQMTQSPSSLSASVGDRVTITCRSSQSLVHSNGNTYLHWYQQKP GKAPKFLIYKVSNRFSGVPSRFSGSGSGTDFTLTISSLQPEDFAT YYCSQSTHVPFTFGQGTKLEIKRTVAAPSVFIFPPSDEQLKSGTA SVVCLLNNFYPREAKVQWKVDNALQSGNSQESVTEQDSKDSTYSL SSTLTLSKADYEKHKVYACEVTHQGLSSPVTKSFNRGEC |

TABLE 8 -continued

Heavy and Light Chain Sequences for Vβ17 bispecific antibodies

| Bispecific Antibody | Amino Acid Sequence |
|---|---|
| Heavy chain 2 Null (SEQ ID NO: 17) | QITLKESGPTLVKPTQTLTLTCTFSGFSLSTSGMGVSWIRQPPGK ALEWLAHIYWDDDKRYNPSLKSRLTITKDTSKNQVVLTMTNMDPV DTATYYCARLYGFTYGFAYWGQGTLVTVSSASTKGPSVFPLAPCS RSTSESTAALGCLVKDYFPEPVTVSWNSGALTSGVHTFPAVLQSS GLYSLSSVVTVPSSSLGTKTYTCNVDHKPSNTKVDKRVESKYGPP CPPCPAPEAAGGPSVFLFPPKPKDTLMISRTPEVTCVVVDVSQED PEVQFNWYVDGVEVHNAKTKPREEQFNSTYRVVSVLTVLHQDWLN GKEYKCKVSNKGLPSSIEKTISKAKGQPREPQVYTLPPSQEEMTK NQVSLWCLVKGFYPSDIAVEWESNGQPENNYKTTPPVLDSDGSFF LYSRLTVDKSRWQEGNVFSCSVMHEALHNHYTQKSLSLSLGK |
| Light Chain 2 Null (SEQ ID NO: 18) | DIVMTQSPDSLAVSLGERATINCRASQSVDYNGISYMHWYQQKPG QPPKLLIYAASNPESGVPDRFSGSGSGTDFTLTISSLQAEDVAVY YCQQIIEDPWTFGQGTKVEIKRTVAAPSVFIFPPSDEQLKSGTAS VVCLLNNFYPREAKVQWKVDNALQSGNSQESVTEQDSKDSTYSLS STLTLSKADYEKHKVYACEVTHQGLSSPVTKSFNRGEC |

Figures 2A, 2B:
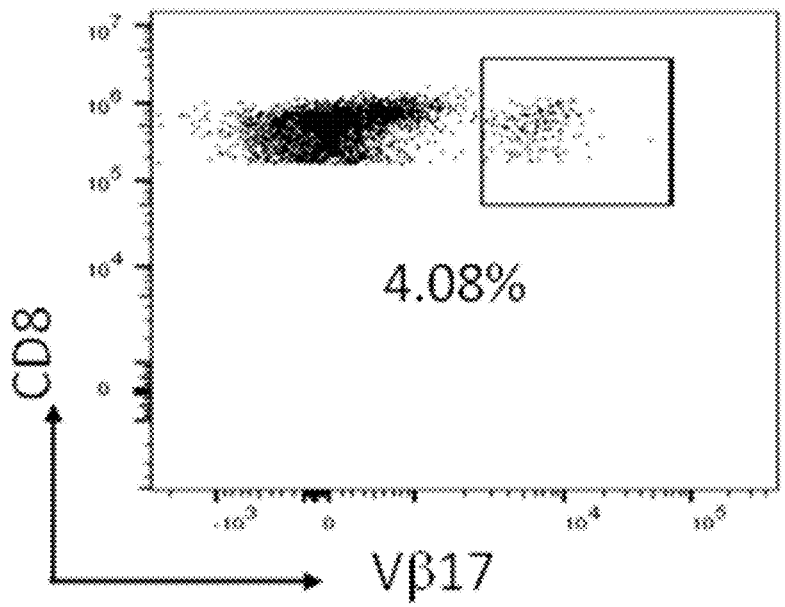
FIGS. 2A-2B show that Vβ17+CD8+ T cells exist in healthy subjects and upon culture with M1 peptide these cells can be expanded in vitro.
Figure 3:
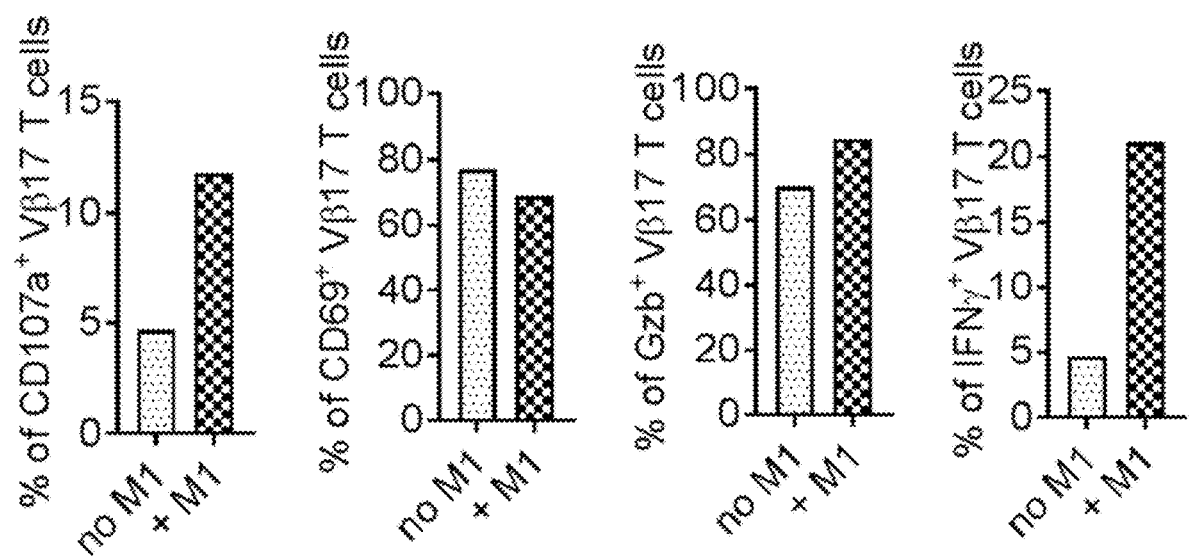
FIG. 3 shows Vβ17+CD8+ T cells have hallmarks of killer cytotoxic cells. Bar graph indicates expression of CD107a, CD69, Granzyme B (Gzb) and Interferon-γ (IFNγ) on gated PBMCs for CD8+ T cells expressing Vβ17 (Vβ17+) on the cell surface at day 0 (no M1) and at day 14 after stimulation with M1 peptide (+M1).
Figure 4:
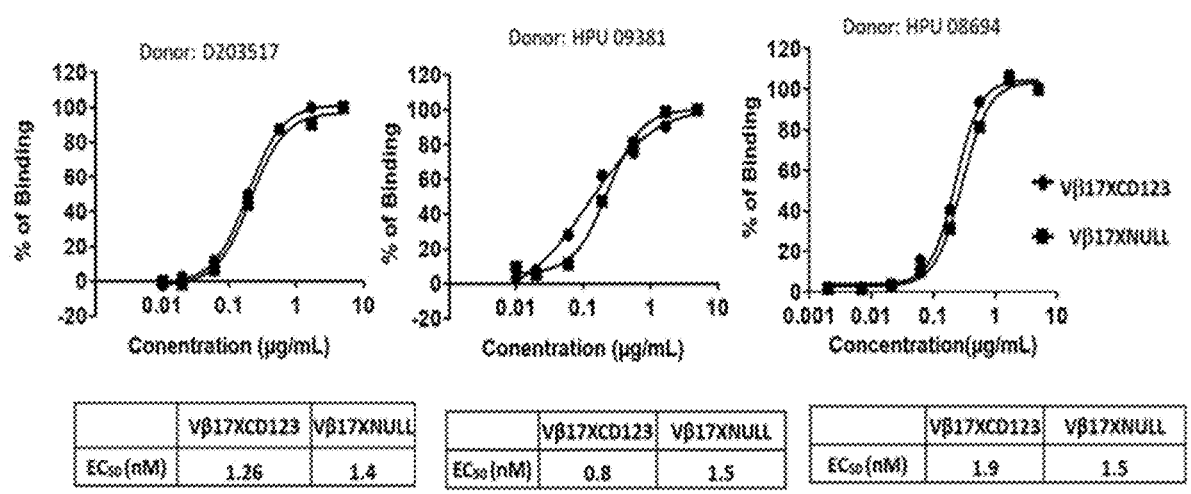
FIG. 4 shows binding of VB11 [anti-Vβ17/anti-CD123] bispecific as well as VB13 [Vβ17 null control bispecific] antibodies to CD8+ T cells. Data presented from CD8+ T cells isolated from PBMCs from 3 different donors (D203517, HPU09381 and HPU08694). The table below each graph presents $EC_{50}$ values for binding in nM.
Figure 5:
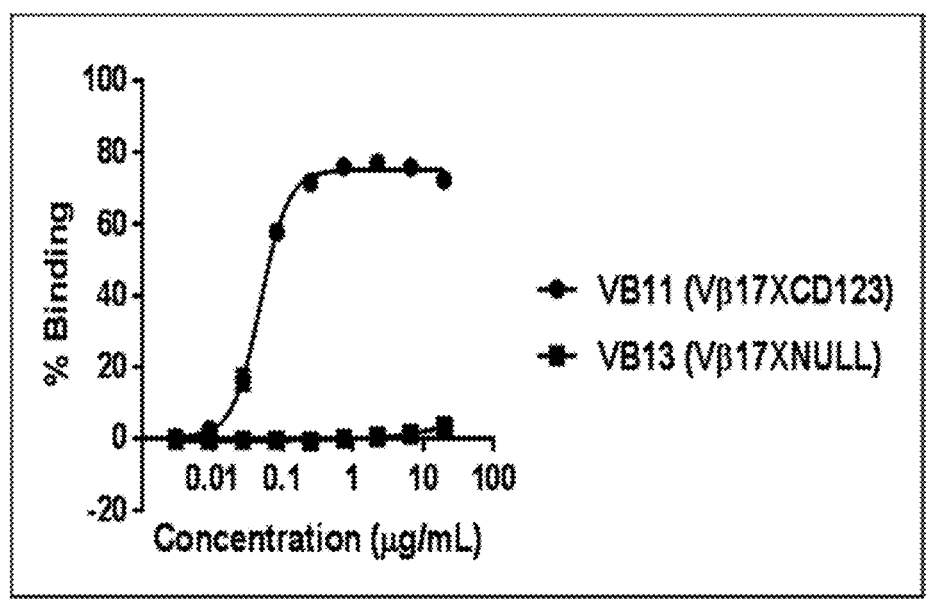
FIG. 5 shows binding of Vβ17 and CD123 bispecific (VB11) as well as Vβ17 null control bispecific (VB13) antibodies to AML cancer cell line. Data presented shows binding of bispecific antibodies to Kasumi3 AML cell line. The table below the graph presents $EC_{50}$ values for binding in nM.
Figure 6:
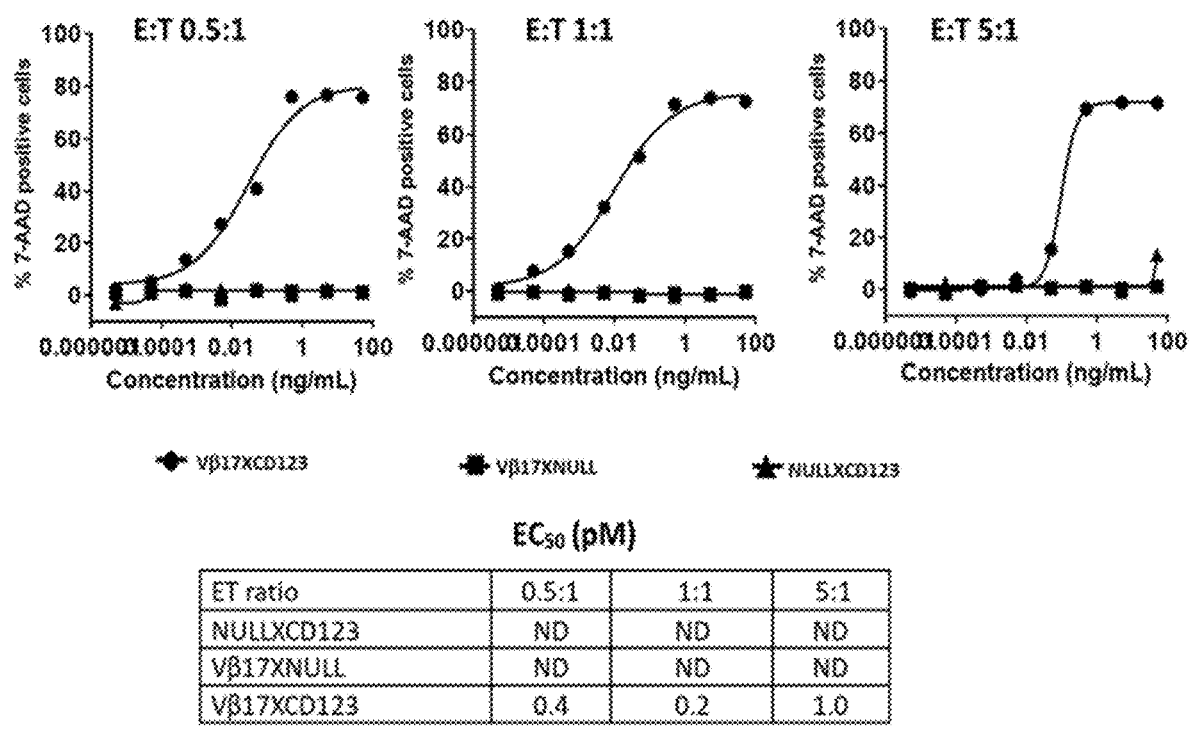
FIG. 6 shows redirection of Vβ17+ T cells by bispecific antibodies that induce efficient killing of AML cancer cells. Data in the left graph shows killing of Kasumi3 cancer cells at an effector to target (E:T) ratio 0.5:1 and dose titration of bispecific antibodies. Data in the middle graph shows killing of Kasumi3 cancer cells at an E:T ratio 1:1 and dose titration of bispecific antibodies. Data in the right graph shows killing of Kasumi3 cancer cells at an E:T ratio 5:1 and dose titration of bispecific antibodies. The table below the graphs shows $EC_{50}$ values calculated from the above graphs given in pM.
Figure 7A:
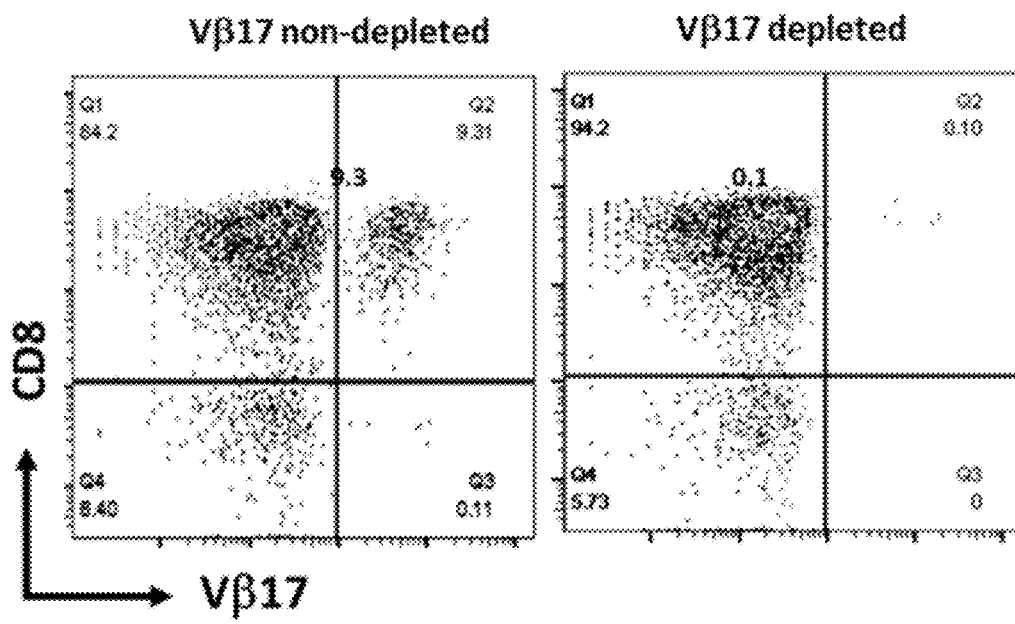
FIGS. 7A-7B show specific binding of an anti-Vβ17/anti-CD123 bispecific antibody (VB11) and a Vβ17 null bispecific antibody (VB13) to CD8+ T cells isolated from PBMCs.
Figure 7B:
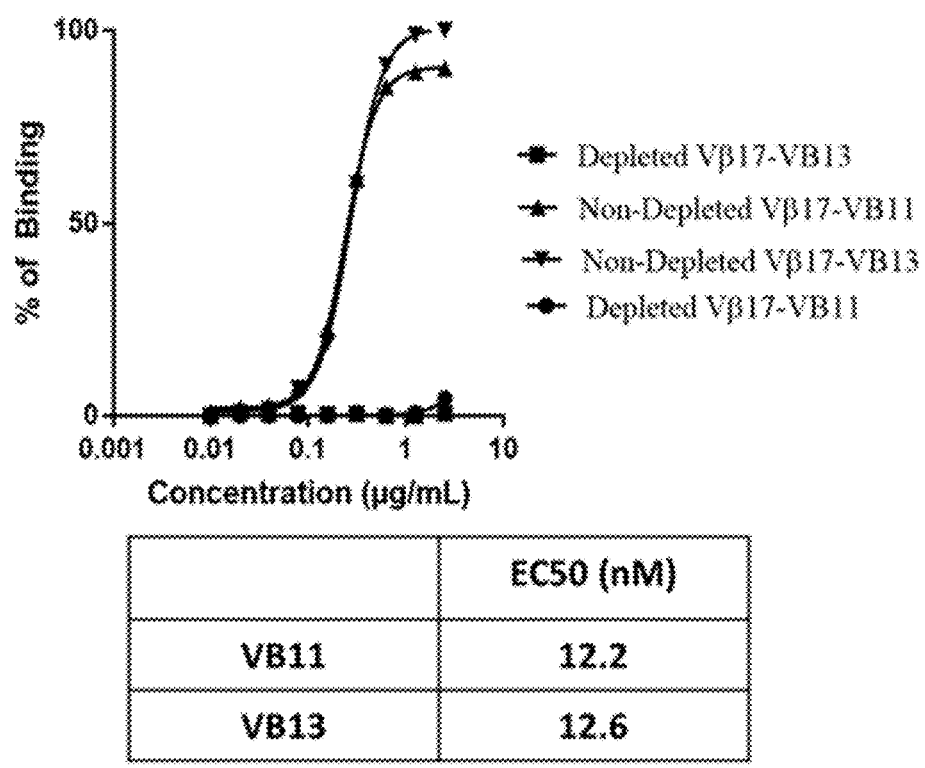
Figure 8:
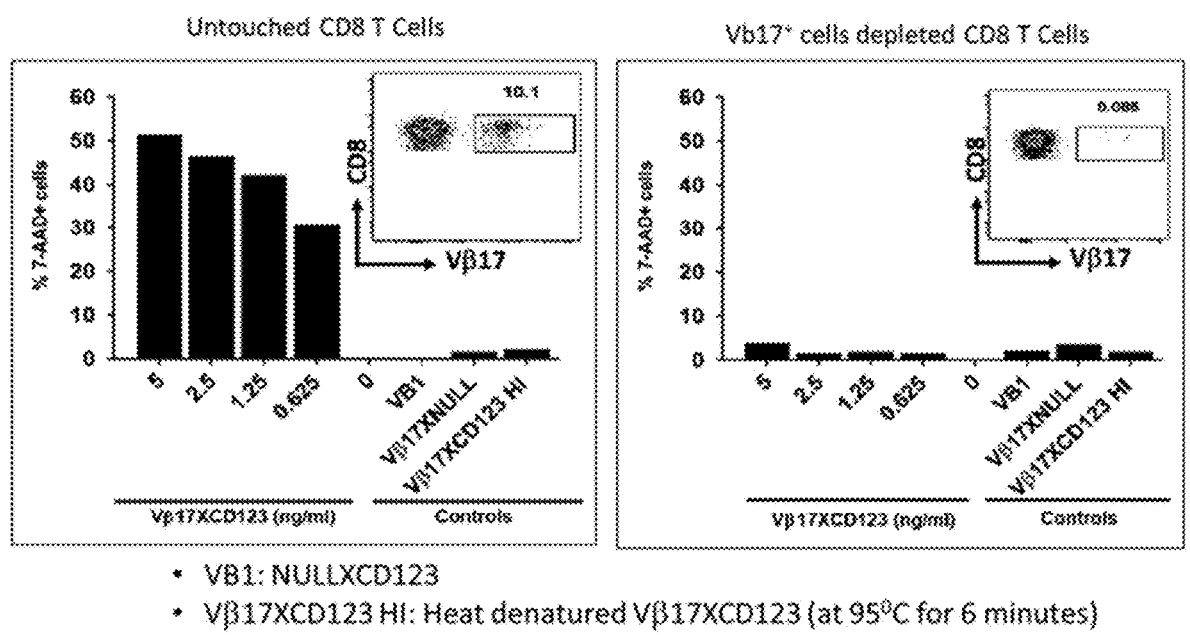
FIG. 8 shows specific recruitment of Vβ17 T cells by a Vβ17-bispecific antibody for killing of Kasumi3 cancer cells. Left figure shows killing of Kasumi3 AML cell line when effectors cells were isolated from PBMCs containing CD8+ T cells expressing Vβ17 (Vβ17+) on the cell surface (untouched CD8 T cells). Insert shows presence of 10.1% Vβ17+CD8 T cells in the effector cell population. Right figure shows killing of Kasumi3 AML cell line when effector CD8+ T cells were isolated from PBMCs, but Vβ17+ T cells were depleted by negative selection. Insert shows presence of a minor population (0.086%) Vβ17+CD8+ T cells in the effector cell population.
Figure 9A:
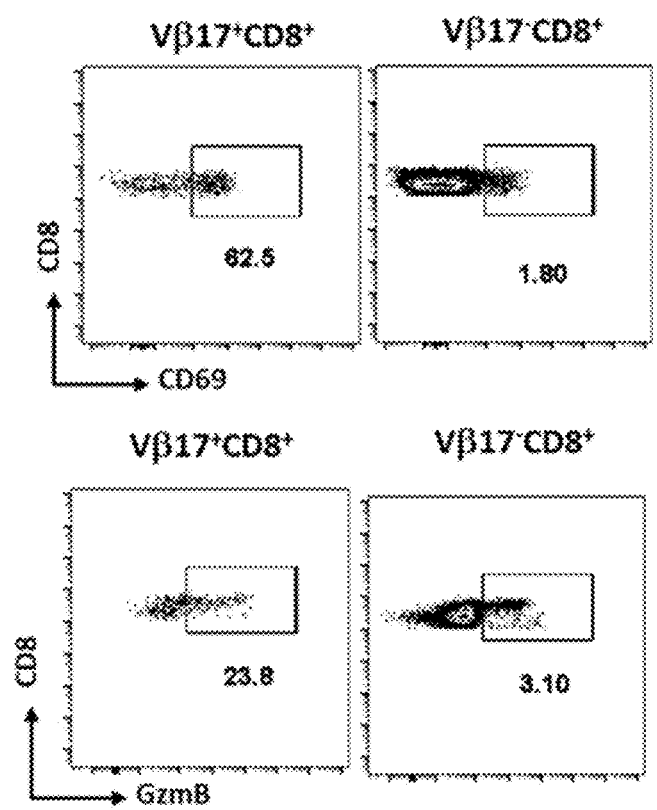
FIGS. 9A-9B show that there is no pan activation of T cells when using Vβ17 bispecific antibodies.
Figure 9B:
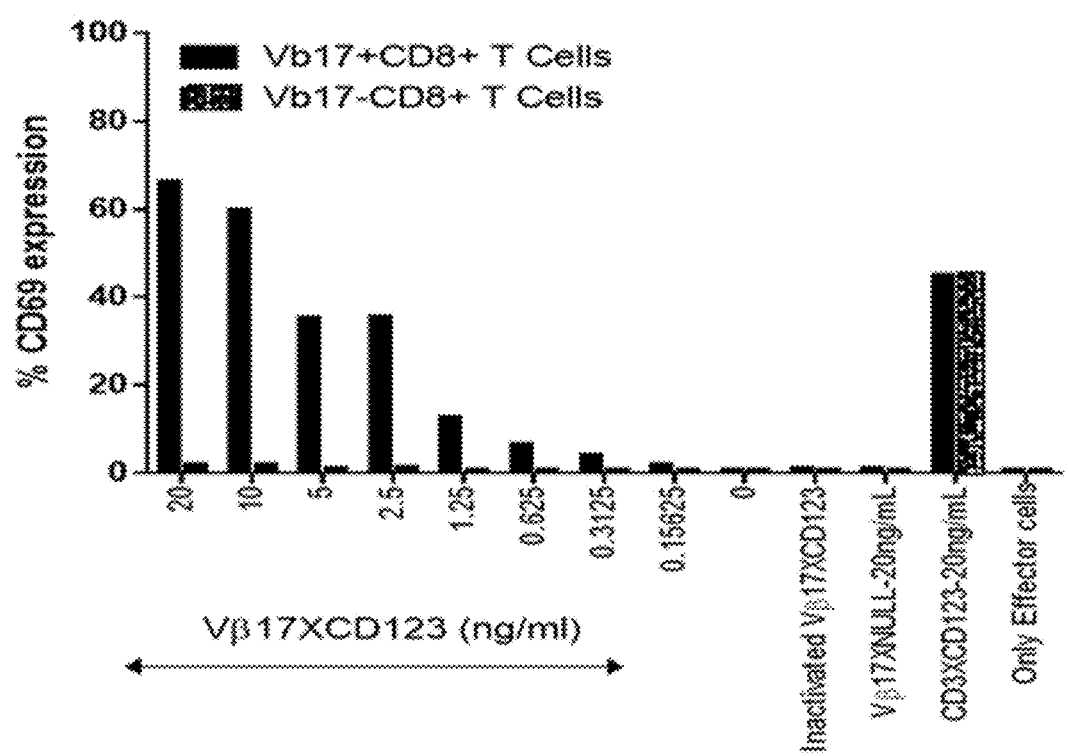
Figure 10:
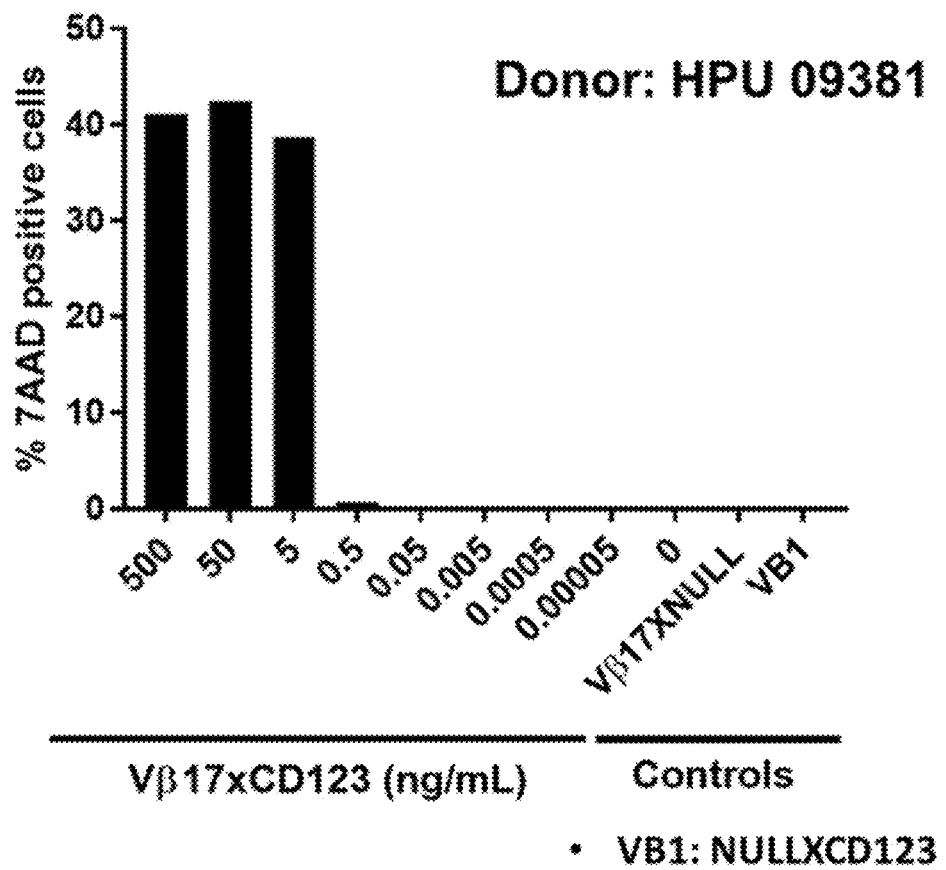
FIG. 10 shows that Vβ17+ T cells from HLA A2 negative donor are also effector killer cells and no pre-stimulation of Vβ17+ cell required. Efficient cytotoxicity mediated by Vβ17 bispecific antibody of Kasumi3 cancer cells is shown from PBMCs containing Vβ17+ T cells from HLA A2 negative donor (HPU 09381).

Example 3. Evaluation of Binding and Cytotoxic Properties of Anti-Vβ17/Anti-CD123 Bispecific Antibodies Example 3.1: Evaluation of Binding and Cytotoxic Properties of Anti-Vβ17/Anti-CD123 Bispecific Antibody Using Kasumi-3 Cells and Human CD8+ T Cells Stimulation and Expansion of Vβ17+ CD8+ T Cells from Total PBMCs To expand Vβ17+ CD8+ T cells, whole PBMCs from HLA-A2 donor (HPU-08694) were stimulated with 1 μg/mL FLU MP 58 peptide (in DMSO). Frequency of Vβ17+ cells among total CD8+ T cells was determined on day 8 and 14 of the culture period. To enumerate the frequency of Vβ17+ cells among total CD8+ T cells, total live PBMCs were initially gated, doublets were excluded, total CD8+ T cells were gated and then Vβ17+ cells were gated (FIG. 2A). Compared to the frequency of Vβ17+ cells among total CD8+ T cells on day 0, a substantial expansion of these cells were observed at day 8 of the culture period (FIG. 2B). A larger fraction of CD8+ T cells on day 8 were Vβ17+ cells (FIG. 2B) in this donor.

Anti-Vβ17/Anti-CD123 Bispecific Antibody Binding Assay

On Kasumi-3 Cells

To understand the binding kinetics of the anti-Vβ17/anti-CD123 bispecific antibody, Kasumi-3 cells were incubated with the anti-Vβ17/anti-CD123 bispecific antibody and Vβ17×NULL arm control at various concentrations (concentration range from 5 μg/mL to 0 μg/mL). Cell bound bispecific antibody was detected with mouse anti-human IgG4 Fc-PE secondary antibody. Table 9 shows the frequency of Kasumi-3 cells positive for PE (secondary antibody) when treated with different concentration of bispecific antibodies. The $EC_{50}$ for anti-Vβ17/anti-CD123 and NULL×CD123 was determined as 6 and 42.7 nM respectively (Table 9).

TABLE 9

Binding affinity of Kasumi-3 cells for bispecific antibodies.

| Conc. (ug/mL) | anti-Vβ17/ anti-CD123 | Vβ17XNULL | NULLXCD123 |
|---|---|---|---|
| 5 | 87.37 | −0.02 | 47.47 |
| 1.667 | 74.37 | 0.09 | 16.37 |
| 0.556 | 24.07 | 0.15 | 1.2 |
| 0.185 | 1.65 | 0.35 | 0.31 |
| 0.062 | 0.32 | 0.12 | 0.04 |
| 0.021 | 0.16 | 0.14 | 0.05 |
| 0.007 | 0.23 | 0.19 | −0.06 |
| 0.002 | 0.04 | −0.09 | −0.04 |
| 0.001 | 0.09 | 0 | −0.18 |
| $EC_{50}$ (μg/mL) | 0.9 | ND | 6.4 |
| $EC_{50}$ (nM) | 6 | ND | 42.7 |

Bispecific antibody binding affinities to Kasumi-3 cells were determined by flow cytometry. Half maximal effective concentration ($EC_{50}$) values were calculated as the bispecific concentration that generates 50% of maximal Binding (PE positive cells). ND: Not determined.

On Enriched CD8+ T Cells

Enriched FLU MP 58 peptide stimulated CD8+ T (from day 14 culture) cells were incubated with various concentrations of anti-Vβ17/anti-CD123 bispecific and Vβ17× NULL arm control antibodies. Mouse anti-human IgG4 Fc-PE secondary antibody was used to detect the bispecific antibody. Table 10 shows the frequency of CD8+ T cells positive for PE (secondary antibody) when treated with different concentration of bispecific antibodies. The $EC_{50}$ for anti-Vβ17/anti-CD123, Vβ17×NULL, was determined as 9.0 nm, 18.7 nm respectively (Table 10).

TABLE 10

Binding activity of CD8+ T cell for bispecific antibodies.

| Conc. (μg/mL) | anti-Vβ17/ anti-CD123 | Vβ17XNULL | NULLXCD123 |
|---|---|---|---|
| 20 | 74.7 | 76.2 | 0.1 |
| 10 | 72.4 | 75.4 | 0.4 |
| 5 | 70.8 | 64.6 | 0.3 |
| 2.5 | 64.8 | 42.5 | 0.5 |
| 1.25 | 38.0 | 32.4 | 0.4 |
| 0.625 | 41.4 | 21.7 | −0.1 |

TABLE 10-continued

Binding activity of CD8+ T cell for bispecific antibodies.

| Conc. (μg/mL) | anti-Vβ17/ anti-CD123 | Vβ17XNULL | NULLXCD123 |
|---|---|---|---|
| 0.3125 | 26.5 | 11.8 | 0.8 |
| 0.15625 | 19.9 | 3.4 | 0.6 |
| 0.078125 | 10.8 | 1.8 | 0.7 |
| $EC_{50}$ (μg/mL) | 1.35 | 2.80 | ND |
| $EC_{50}$ (nM) | 9 | 18.7 | ND |

Bispecific antibody binding affinities to CD8+ T cell were determined by flow cytometry. Half maximal effective concentration ($EC_{50}$) values were calculated as the antibody concentration that generates 50% of the maximal binding (PE positive cells). ND: Not Determined Bispecific Mediated Cytotoxicity Assay In order to analyze the potency of the anti-Vβ17/anti-CD123 bispecific antibody mediated cytotoxicity, CFSE labelled target (Kasumi-3) cells were co-cultured with stimulated CD8+ T cells (effectors) from day 14 of culture at an effector to target (ET) ratio 0.5:1, 1:1, 5:1 for 14 and 24 hours with various concentrations of anti-Vβ17/anti-CD123 bispecific and Vβ17xNULL arm control antibody. CD123 expression on target Kasumi-3 cells were checked by using a commercially available anti-CD123 antibody. Target cells (Kasumi-3) were labelled with CFSE to identify them as CFSE+ during flow cytometry analysis. Post co-culture period, 7-AAD was added to analyze the percentage of 7-AAD+ CFSE+ cells as a measure of cytotoxicity. Basal cytotoxicity observed in the absence of bispecific antibody was subtracted to obtain specific cytotoxicity in response to bispecific antibody. The assay was performed once with a single donor (HPU-08694). The $EC_{50}$ for the anti-Vβ17/anti-CD123 bispecific antibody at 0.5:1, 1:1 and 5:1 ET ratios for 14-hour time point were 3.7, 0.1 and 0.133 pM respectively (Table 11).

TABLE 11

Summary of $EC_{50}$ values for various bispecific antibodies upon co-culturing FLU MP 58 peptide stimulated CD8+ T cell with Kasumi-3 cells at ET ratios 0.5:1, 1:1 and 5:1 for 14 hours.

| | $EC_{50}$ (ng/mL) | | |
|---|---|---|---|
| Bispecific Ab | E:T Ratio (0.5:1) | E:T Ratio (1:1) | E:T Ratio (5:1) |
| NULLXCD123 | UD | UD | UD |
| Vβ17XNULL | UD | UD | UD |
| Anti-Vβ17/anti-CD123 | 0.55 | 0.015 | 0.02 |

| | $EC_{50}$ (pM) | | |
|---|---|---|---|
| Bispecific Ab | E:T Ratio (0.5:1) | E:T Ratio (1:1) | E:T Ratio (5:1) |
| NULLXCD123 | UD | UD | UD |
| Vβ17XNULL | UD | UD | UD |
| anti-Vβ17/anti-CD123 | 3.7 | 0.1 | 0.133 |

UD: Undetectable, as the activity was too low for proper curve fitting

The $EC_{50}$ for the anti-Vβ17/anti-CD123 bispecific at 0.5:1, 1:1 and 5:1 ET ratio for 24-hour time point were 0.4, 0.2 and 1.0 pM respectively (Table 12).

TABLE 12

Summary of $EC_{50}$ values for various bispecific antibodies upon co-culturing FLU MP 58 peptide stimulated CD8+ T cells with Kasumi-3 cells at ET ratios 0.5:1, 1:1 and 5:1 for 24 hours.

| | $EC_{50}$ (ng/mL) | | |
|---|---|---|---|
| Bispecific Ab | E:T Ratio (0.5:1) | E:T Ratio (1:1) | E:T Ratio (5:1) |
| NULLXCD123 | UD | UD | UD |
| Vβ17XNULL | UD | UD | UD |
| anti-Vβ17/anti-CD123 | 0.06 | 0.03 | 0.15 |

| | $EC_{50}$ (pM) | | |
|---|---|---|---|
| Bispecific Ab | E:T Ratio (0.5:1) | E:T Ratio (1:1) | E:T Ratio (5:1) |
| NULLXCD123 | UD | UD | UD |
| Vβ17XNULL | UD | UD | UD |
| anti-Vβ17/anti-CD123 | 0.4 | 0.2 | 1.0 |

UD: Undetectable

Similarly, anti-Vβ17/anti-CD123 bispecific mediated unstimulated CD8+ T cell cytotoxicity was tested at ET ratio 0.5:1, 1:1, 5:1 for 14 (Table 13) and 24 (Table 14) hours. At 5 ng/ml anti-Vβ17/anti-CD123 bispecific concentration and 14-hour time point, unstimulated CD8+ T cells at 0.5:1 and 1:1 ET ratio showed 2.8% and 9.8% target cell cytotoxicity respectively (Table 13), compared to 77% and 73% cytotoxicity by stimulated CD8+ T cells. At 5:1 ET ratio, unstimulated CD8+ T cells exhibited 31.65% target cytotoxicity, compared to 70.9% by stimulated CD8+ T cells. Similar results were obtained from 24-hour time point (Table 12, 15, 16, and 17). At highest concentration (5 ng/ml) of anti-Vβ17/anti-CD123 bispecific tested, unstimulated CD8+ T cells exhibited higher cytotoxicity towards target cells at a higher ET ratio.

TABLE 13

Cytotoxicity assay with unstimulated CD8+ T cells at various ET ratios for 14 hours. Frequency of CFSE and 7-AAD positive cells when treated with different concentrations of bispecific antibodies.

| Bispecific Ab | Conc (ng/mL) | E:T Ratio (0.5:1) | E:T Ratio (1:1) | E:T Ratio (5:1) |
|---|---|---|---|---|
| NULLXCD123 | 5 | 1.3 | −0.6 | −0.45 |
| | 0.005 | 1.3 | −0.5 | 0.45 |
| Vβ17XNULL | 5 | −0.6 | −0.8 | 3.25 |
| | 0.005 | −0.3 | 1 | −1.35 |
| anti-Vβ17/ anti-CD123 | 5 | 2.8 | 9.8 | 31.65 |
| | 0.005 | 0.1 | 3.2 | 12.25 |

TABLE 14

Cytotoxicity assay with unstimulated CD8+ T cells at various ET ratios for 24 hours. Frequency of CFSE and 7-AAD positive cells when treated with different concentrations of bispecific antibodies.
Unstimulated CD8 + T cells

| Bispecific Ab | Conc (ng/mL) | E:T Ratio (0.5:1) | E:T Ratio (1:1) | E:T Ratio (5:1) |
|---|---|---|---|---|
| NULLXCD123 | 5 | −1.3 | −0.55 | −4.85 |
| | 0.005 | −2 | −0.85 | −2.95 |
| Vβ17XNULL | 5 | −0.8 | −1.35 | 10.85 |
| | 0.005 | −1 | −1.05 | −1.95 |
| anti-Vβ17/ anti-CD123 | 5 | 4.8 | 11.55 | 30.65 |
| | 0.005 | 1.5 | 1.75 | 10.95 |

TABLE 15

Cytotoxicity assay at 0.5:1 ET ratio (stimulated CD8+ T cell: Kasumi-3 cells) upon incubation for 14 hrs. Frequency of CFSE and 7-AAD positive cells when treated with different concentrations of bispecific antibodies at 0.5:1 ET ratio for 14 hrs.

| Conc. (ng/mL) | NULLXCD123 | Vβ17XNULL | anti-Vβ17/ anti-CD123 |
|---|---|---|---|
| 50 | 3.47 | 2.57 | 77.07 |
| 5 | 2.67 | 2.17 | 77.47 |
| 0.5 | −0.73 | 1.87 | 46.77 |
| 0.05 | 0.77 | 1.67 | 3.77 |
| 0.005 | −0.03 | 1.47 | 1.97 |
| 0.0005 | 0.67 | 1.07 | 2.17 |
| 0.00005 | 1.67 | 0.17 | 0.17 |
| 0.000005 | −0.43 | 3.27 | 0.87 |
| $EC_{50}$ (ng/mL) | ND | ND | 0.55 |
| $EC_{50}$ (pM) | ND | ND | 3.7 |

Half maximal effective concentration ($EC_{50}$) values were calculated as the antibody concentration that generates 50% of maximal cytotoxicity (CFSE+ 7AAD+) cells. ND: Not Determined.

TABLE 16

Cytotoxicity assay at 1:1 ET ratio (stimulated CD8+ T cell: Kasumi-3 cells) upon incubation for 14 hrs. Frequency of CFSE and 7-AAD positive cells when treated with different concentrations of bispecific antibodies at 11 ET ratio for 14 hrs.

| Conc.(ng/mL) | NULLXCD123 | Vβ17XNULL | anti-Vβ17/ anti-CD123 |
|---|---|---|---|
| 50 | 0.6 | −0.5 | 76.0 |
| 5 | 0.1 | 0.9 | 73.0 |
| 0.5 | 1.0 | 0.9 | 77.9 |
| 0.05 | 0.4 | 1.8 | 59.4 |
| 0.005 | 1.8 | 0.9 | 36.8 |
| 0.0005 | 0.9 | 1.1 | 18.0 |
| 0.00005 | 0.7 | 0.9 | 6.1 |
| 0.000005 | 1.6 | 0.8 | 1.9 |
| $EC_{50}$ (ng/mL) | ND | ND | 0.015 |
| $EC_{50}$ (pM) | ND | ND | 0.1 |

Half maximal effective concentration ($EC_{50}$) values were calculated as the antibody concentration that generates 50% of maximal cytotoxicity (CFSE+ 7AAD+) cells. ND: Not Determined

TABLE 17

Cytotoxicity assay at 5:1 E:T ratio (stimulated CD8+ T cell: Kasumi-3 cells) upon incubation for 14 hrs. Frequency of CFSE and 7-AAD positive cells when treated with different concentrations of bispecific antibodies at 5:1 ET ratio for 14 hrs.

| Conc.(ng/mL) | NULLXCD123 | Vβ17XNULL | anti-β17/ anti-CD123 |
|---|---|---|---|
| 50 | 2.3 | 0.0 | 70.2 |
| 5 | 3.1 | 2.7 | 70.9 |
| 0.5 | 1.8 | 4.4 | 74.5 |
| 0.05 | 3.0 | 1.5 | 73.2 |
| 0.005 | 2.1 | 1.6 | 2.5 |
| 0.0005 | 2.9 | 3.5 | 1.4 |
| 0.00005 | 3.2 | 5.5 | 2.5 |
| 0.000005 | 4.1 | 4.4 | 4.8 |
| $EC_{50}$ (ng/mL) | UD | UD | 0.02 |
| $EC_{50}$ (pM) | UD | UD | 0.13 |

Half maximal effective concentration ($EC_{50}$) values were calculated as the antibody concentration that generates 50% of maximal cytotoxicity (CFSE+ 7AAD+) cells. UD: Undetectable.

Example 3.2. Evaluation of Binding and Cytotoxic Properties of Anti-Vβ17/Anti-CD123 Bispecific Antibody In Vivo Vβ17/CD123 multispecific antibodies were generated essentially as described above, and injected into a mouse model having a lymphoma tumor expressing CD123. The Vβ17/CD123 multispecific antibody was administered to the mice. A negative control group was administered PBS. Mean tumor volume was measured at day 0, and each 3 days thereafter for the first month. The results showed statistically significant tumor growth inhibition (TGI) of 74% as compared to the negative control (data not shown), which was also supported by ex vivo imaging studies of the tumor, lymph nodes and spleen (data not shown). Together the results show an effective and efficient penetration of Vβ17+ T cells to tumor tissues using Vβ17 multispecific antibodies provided herein.

Example 4—Multispecific Antibodies that Bind Vβ17 and BCMA

Example 4.1: Anti-Vβ17 Antibody Generation

Immunogen. A recombinant human TCR Vβ17×Vα10.2 fused to a human Fc was used as an immunogen, and the sequence is listed in Table 18.

TABLE 18

Amino acid sequence of the immunogen.

| Protein ID | | 'Knob' arm and 'hole' arm amino acid sequence | SEQ ID NO: |
|---|---|---|---|
| TCR Vβ17 × Vα10.2 fused to human Fc | vβ17- TRBC2-hFc | VDGGITQSPKYLFRKEGQNVTLSCEQNLNHDAMYWYRQDPGQGLRLIY YSQIVNDFQKGDIAEGYSVSREKKESFPLTVTSAQKNPTAFYLCASSS RSSYEQYFGPGTRLTVTEDLKNVFPPEVAVFEPSEAEISHTQKATLVC LATGFYPDHVELSWWVNGKEVHSGVSTDPQPLKEQPALNDSRYSLSSR LRVSATFWQNPRNHFRCQVQFYGLSENDEWTQDRAKPVTQIVSAEAWG RADEPKSCDKTHTCPPCPAPELLGGPSVFLFPPKPKDTLMISRTPEVT CVVVDVSHEDPEVKFNWYVDGVEVHNAKTKPREEQYNSTYRVVSVLTV LHQDWLNGKEYKCKVSNKALPAPIEKTISKAKGQPREPQVYVLPPSRE EMTKNQVSLLCLVKGFYPSDIAVEWESNGQPENNYLTWPPVLDSDGSF FLYSKLTVDKSRWQQGNVFSCSVMHEALHNHYTQKSLSLSPGK | 560 |
| | Vα10.2- TRAC-hFc | QLLEQSPQFLSIQEGENLTVYCNSSSVFSSLQWYRQEPGEGPVLLVTV VTGGEVKKLKRLTFQFGDARKDSSLHITAAQPGDTGLYLCAGAGSQGN LIFGKGTKLSVKPNIQNPDPAVYQLRDSKSSDKSVCLFTDFDSQTNVS QSKDSDVYITDKTVLDMRSMDFKSNSAVAWSNKSDFACANAFNNSIIP EDTFFPSEPKSCDKTHTCPPCPAPELLGGPSVFLFPPKPKDTLMISRT | 561 |

TABLE 18-continued

Amino acid sequence of the immunogen.

| Protein ID | 'Knob' arm and 'hole' arm amino acid sequence | SEQ ID NO: |
|---|---|---|
| | PEVTCVVVDVSHEDPEVKFNWYVDGVEVHNAKTKPREEQYNSTYRVVS VLTVLHQDWLNGKEYKCKVSNKALPAPIEKTISKAKGQPREPQVYVYP PSREEMTKNQVSLTCLVKGFYPSDIAVEWESNGQPENNYKTTPPVLDS DGSFALVSKLTVDKSRWQQGNVFSCSVMHEALHNHYTQKSLSLSPGK | |

Protein Production of the Immunogen. Expression plasmids encoding the immunogen (see Table 18) were transfected into CHO cell at a DNA ratio of 1:1. Total amount of DNA for a 750 mL expression scale was 750 ug. Final expression volume was 1 L after two feedings and enhancer additions. Using an ÄKTAprime plus instrument (GE Healthcare Life Sciences), supernatant (1 L) after 7 days was applied with a flow-rate of 5 mL/min to a MAB SELECT SURE (GE Life Sciences) with a column volume (CV) of 10 mL pre-equilibrated with Phosphate buffered saline (PBS), pH 6.8. Non-specific proteins binding to the column material was washed off with PBS supplemented with 500 mM NaCl, pH 6.8 (5 CV). The Fc containing the immunogen was eluted stepwise with 40 mM sodium acetate pH 5.0 (5 CV), pH 4.5 (5 CV), pH 4.0 (10 CV), pH 3.5 (5 CV), and pH 3.0 (5 CV). Majority of the target protein eluted at the pH 4.0 step. Fractions were pooled, and applied (5 mL) at a flow-rate of 0.2 mL/min on to a HILOAD 16/600 SUPERDEX (GE Healthcare) column pre-equilibrated with PBS (pH 6.8). Target protein was eluted, pooled, and analyzed by SDS-PAGE, analytic SEC, intact mass by MS. Purity estimated to 99.5%.

Immunization in mouse and screening of Vβ17 binder. Wild type mouse with 6 different MHC combinations was immunized using rapid immunization protocol. Eight mice were selected for cell fusion based on serum titer. Hybridoma supernatants were screened by Luminex using the immunogen and expanded Vβ17+ T cells. Hits were V-region recovered and formatted directly into bispecific antibodies.

Example 4.2: Production and De Novo Sequencing of Anti-BCMA Mab

An anti-BCMA clone was obtained and sequenced. The three VH CDR and three VL CDR sequences of anti-BCMA (BCMB519) are shown in Table 19a (SEQ ID NOs:89-94, respectively); and the VH and VL sequences of the anti-BCMA antibody are shown in Table 19b (SEQ ID NOs:95 and 96, respectively).

TABLE 19a

CDR sequences of anti-BCMA mAb.

| mAb ID | HCDR1 | SEQ ID NO: | HCDR2 | SEQ ID NO: | HCDR3 | SEQ ID NO: |
|---|---|---|---|---|---|---|
| BCMB519 | GFTFSSYA | 89 | ISGSGGST | 90 | AKDEGYSSGHYYGMDV | 91 |

| mAb ID | HCDR1 | SEQ ID NO: | HCDR2 | SEQ ID NO: | HCDR3 | SEQ ID NO: |
|---|---|---|---|---|---|---|
| BCMB519 | QSISSSF | 92 | GAS | 93 | QHYGSSPMYT | 94 |

TABLE 19b

VH and VL sequences of anti-BCMA mAb.

| mAb ID | VH Amino Acid Sequence | SEQ ID NO: |
|---|---|---|
| BCMB519 | EVQLLESGGGLVQPGGSLRLSCAASGFTFSSYAMSWVRQAPGKG LEWVSAISGSGGSTYYADSVKGRFTISRDNSKNTLYLQMNSLRAE DTAVYYCAKDEGYSSGHYYGMDVWGQGTTVTVSS | 95 |

| mAb ID | VL Amino Acid Sequence | SEQ ID NO: |
|---|---|---|
| BCMB519 | EIVLTQSPGTLSLSPGERATLSCRASQSISSSFLTWYQQKPGQAPRL LIYGASSRATGIPDRFSGGGSGTDFTLTISRLEPEDFAVYYCQHYG SSPMYTFGQGTKLEIK | 96 |

Example 4.3: Preparation of
Anti-Vβ17/Anti-BCMA Bispecific Antibodies

All the bispecific antibodies were produced as full-length antibodies in the knob-into-hole format as human IgG1, as previously described (Atwell et al. J. Mol. Biol. 270: 26-35, 1997). Nucleic acid sequences encoding variable regions were subcloned into a custom mammalian expression vectors containing constant region of IgG1 Fc silent expression cassettes using standard PCR restriction enzyme based cloning techniques. The bispecific antibodies were expressed by transient transfection in Chinese hamster ovary cell line.

The sequences of the bispecific antibodies expressed in the CHO cells are shown in Table 20 below.

TABLE 20

Sequences of antibodies expressed in CHO cells

| Bispecific Antibody | Chain info | Amino Acid Sequence | SEQ ID NO: |
|---|---|---|---|
| Vb17 x BCMA (B17B622) | Heavy Chain 1 Vb17_202 B4D1 | MAWVWTLLFLMAAAQSIQAVQLKESGPGLVAPSQSLSITC TVSGFSLTSYGVHWVRQPPGKGLEWLGIIWAGGGTNYNSA LMSRLSITKDNSKSQVSLKMNSLQTDDTAMYYCARGTFFN YDYFDYWGQGTTLTVSSASTKGPSVFPLAPSSKSTSGGTAA LGCLVKDYFPEPVTVSWNSGALTSGVHTFPAVLQSSGLYSL SSVVTVPSSSLGTQTYICNVNHKPSNTKVDKKVEPKSCDKT HTCPPCPAPEAAGGPSVFLFPPKPKDTLMISRTPEVTCVVVS VSHEDPEVKFNWYVDGVEVHNAKTKPREEQYNSTYRVVSV LTVLHQDWLNGKEYKCKVSNKALPAPIEKTISKAKGQPREP QVYVYPPSREEMTKNQVSLTCLVKGFYPSDIAVEWESNGQP ENNYKTTPPVLDSDGSFALVSKLTVDKSRWQQGNVFSCSV MHEALHNRFTQKSLSLSPG | 562 |
| | Light Chain 1 Vb17_202 B4D1 | MAWVWTLLFLMAAAQSIQADIVMTQSQKFMSTSVGDRVSI TCKASQDVGTDVAWYQQKPGQSPKLMIYWASTRHTGVPD RFTGSGSGTDFTLTISNVQSEDLADYFCQQYSRYPWTFGAG TKLELKRTVAAPSVFIFPPSDEQLKSGTASVVCLLNNFYPRE AKVQWKVDNALQSGNSQESVTEQDSKDSTYSLSSTLTLSKA DYEKHKVYACEVTHQGLSSPVTKSFNRGEC | 563 |
| | Heavy Chain 2 BCMB519 | MAWVWTLLFLMAAAQSIQAEIVLTQSPGTLSLSPGERATLS CRASQSISSSFLTWYQQKPGQAPRLLIYGASSRATGIPDRFSG GGSGTDFTLTISRLEPEDFAVYYCQHYGSSPMYTFGQGTKL EIKGGSEGKSSGSGSESKSTGGSEVQLLESGGGLVQPGGSLR LSCAASGFTFSSYAMSWVRQAPGKGLEWVSAISGSGGSTYY ADSVKGRFTISRDNSKNTLYLQMNSLRAEDTAVYYCAKDE GYSSGHYYGMDVWGQGTTVTVSSEPKSSDKTHTCPPCPAP EAAGGPSVFLFPPKPKDTLMISRTPEVTCVVVSVSHEDPEVK FNWYVDGVEVHNAKTKPREEQYNSTYRVVSVLTVLHQDW LNGKEYKCKVSNKALPAPIEKTISKAKGQPREPQVYVLPPSR EEMTKNQVSLLCLVKGFYPSDIAVEWESNGQPENNYLTWPP VLDSDGSFFLYSKLTVDKSRWQQGNVFSCSVMHEALHNHY TQKSLSLSPG | 559 |
| Vb17 x BCMA (B17B624) | Heavy Chain 1 Vb17_210 E10A1 | MAWVWTLLFLMAAAQSIQAVQLKESGPGLVAPSQSLSITC TVSGFSLTSYGVHWVRQPPGKGLEWLGIIWAGGNTNSNSAL MSRLSISKDNSKSQVFLKMNSLQTDDTAMYYCARGSFYSYL YFDYWGQGTTLTVSSASTKGPSVFPLAPSSKSTSGGTAALG CLVKDYFPEPVTVSWNSGALTSGVHTFPAVLQSSGLYSLSS VVTVPSSSLGTQTYICNVNHKPSNTKVDKKVEPKSCDKTHT CPPCPAPEAAGGPSVFLFPPKPKDTLMISRTPEVTCVVVSVS HEDPEVKFNWYVDGVEVHNAKTKPREEQYNSTYRVVSVLT VLHQDWLNGKEYKCKVSNKALPAPIEKTISKAKGQPREPQV YVYPPSREEMTKNQVSLTCLVKGFYPSDIAVEWESNGQPEN NYKTTPPVLDSDGSFALVSKLTVDKSRWQQGNVFSCSVMH EALHNRFTQKSLSLSPG | 564 |
| | Light Chain 1 Vb17_210 E10A1 | MAWVWTLLFLMAAAQSIQADIVMTQSPSYLAASPGETITIN CRASKSISKYLAWYQEKPGKTNKLLIYSGSTLQSGIPSRFSGS GSGTDFTLTISSLEPEDFAMYYCQQHNDYPLTFGAGTKLEL KRTVAAPSVFIFPPSDEQLKSGTASVVCLLNNFYPREAKVQ WKVDNALQSGNSQESVIEQDSKDSTYSLSSTLTLSKADYEK HKVYACEVTHQGLSSPVTKSFNRGEC | 565 |
| | Heavy Chain 2 BCMB519 | MAWVWTLLFLMAAAQSIQAEIVLTQSPGTLSLSPGERATLS CRASQSISSSFLTWYQQKPGQAPRLLIYGASSRATGIPDRFSG GGSGTDFTLTISRLEPEDFAVYYCQHYGSSPMYTFGQGTKL EIKGGSEGKSSGSGSESKSTGGSEVQLLESGGGLVQPGGSLR LSCAASGFTFSSYAMSWVRQAPGKGLEWVSAISGSGGSTYY ADSVKGRFTISRDNSKNTLYLQMNSLRAEDTAVYYCAKDE GYSSGHYYGMDVWGQGTTVTVSSEPKSSDKTHTCPPCPAP EAAGGPSVFLFPPKPKDTLMISRTPEVTCVVVSVSHEDPEVK FNWYVDGVEVHNAKTKPREEQYNSTYRVVSVLTVLHQDW LNGKEYKCKVSNKALPAPIEKTISKAKGQPREPQVYVLPPSR EEMTKNQVSLLCLVKGFYPSDIAVEWESNGQPENNYLTWPP VLDSDGSFFLYSKLTVDKSRWQQGNVFSCSVMHEALHNHY TQKSLSLSPG | 559 |

TABLE 20-continued

Sequences of antibodies expressed in CHO cells

| Bispecific Antibody | Chain info | Amino Acid Sequence | SEQ ID NO: |
|---|---|---|---|
| Null x BCMA (B17B612) | Heavy Chain 1 B21M | MAWVWTLLFLMAAAQSIQAQITLKESGPTLVKPTQTLTLTC TFSGFSLSTSGMGVSWIRQPPGKALEWLAHIYWDDDKRYNP SLKSRLTITKDTSKNQVVLTMTNMDPVDTATYYCARLYGFT YGFAYWGQGTLVTVSSASTKGPSVFPLAPSSKSTSGGTAAL GCLVKDYFPEPVTVSWNSGALTSGVHTFPAVLQSSGLYSLS SVVTVPSSSLGTQTYICNVNHKPSNTKVDKKVEPKSCDKTH TCPPCPAPEAAGGPSVFLFPPKPKDTLMISRTPEVTCVVVSVS HEDPEVKFNWYVDGVEVHNAKTKPREEQYNSTYRVVSVLT VLHQDWLNGKEYKCKVSNKALPAPIEKTISKAKGQPREPQV YVYPPSREEMTKNQVSLTCLVKGFYPSDIAVEWESNGQPEN NYKTTPPVLDSDGSFALVSKLTVDKSRWQQGNVFSCSVMH EALHNRFTQKSLSLSPG | 566 |
| | Light Chain 1 B21M | METHSQVFVYMLLWLSGVEGDIVMTQSPDSLAVSLGERATI NCRASQSVDYNGISYMHWYQQKPGQPPKLLIYAASNPESG VPDRFSGSGSGTDFTLTISSLQAEDVAVYYCQQIIEDPWTFG QGTKVEIKRTVAAPSVFIFPPSDEQLKSGTASVVCLLNNFYP REAKVQWKVDNALQSGNSQESVTEQDSKDSTYSLSSTLTLS KADYEKHKVYACEVTHQGLSSPVTKSFNRGEC | 567 |
| | Heavy Chain 2 BCMB519 | MAWVWTLLFLMAAAQSIQAEIVLTQSPGTLSLSPGERATLS CRASQSISSSFLTWYQQKPGQAPRLLIYGASSRATGIPDRFSG GGSGTDFTLTISRLEPEDFAVYYCQHYGSSPMYTFGQGTKL EIKGGSEGKSSGSGSESKSTGGSEVQLLESGGGLVQPGGSLR LSCAASGFTFSSYAMSWVRQAPGKGLEWVSAISGSGGSTYY ADSVKGRFTISRDNSKNTLYLQMNSLRAEDTAVYYCAKDE GYSSGHYYGMDVWGQGTTVTVSSEPKSSDKTHTCPPCPAP EAAGGPSVFLFPPKPKDTLMISRTPEVTCVVVSVSHEDPEVK FNWYVDGVEVHNAKTKPREEQYNSTYRVVSVLTVLHQDW LNGKEYKCKVSNKALPAPIEKTISKAKGQPREPQVYVLPPSR EEMTKNQVSLLCLVKGFYPSDIAVEWESNGQPENNYLTWPP VLDSDGSFFLYSKLTVDKSRWQQGNVFSCSVMHEALHNHY TQKSLSLSPG | 559 |
| ScFv Sequences | | | |
| B17B621 ZWA: Va10.2-TRVAB1-Fab-RF ZWB: BCMB519-scFv | Heavy Chain 1 Va10.2-TRVAB1 | MAWVWTLLFLMAAAQSIQAVQLQQSGPELVKPGASVKM SCKASGNTIPTYVMHWVKLKPGQGLEWIGYINPYNDGTKY NEKFKGKATLTSDKSSSTAYMELSSLTSEDSAVYYCAKDGT YVEFAYWGQGTLVTVSSAASTKGPSVFPLAPSSKSTSGGTAA LGCLVKDYFPEPVTVSWNSGALTSGVHTFPAVLQSSGLYSL SSVVTVPSSSLGTQTYICNVNHKPSNTKVDKKVEPKSCDKT HTCPPCPAPEAAGGPSVFLFPPKPKDTLMISRTPEVTCVVVS VSHEDPEVKFNWYVDGVEVHNAKTKPREEQYNSTYRVVSV LTVLHQDWLNGKEYKCKVSNKALPAPIEKTISKAKGQPREP QVYVYPPSREEMTKNQVSLTCLVKGFYPSDIAVEWESNGQP ENNYKTTPPVLDSDGSFALVSKLTVDKSRWQQGNVFSCSV MHEALHNRFTQKSLSLSPG | 568 |
| | Light Chain 1 Va10.2-TRVAB1 | MAWVWTLLFLMAAAQSIQADIVMTQSRKFMSTSVGDRVNI TCKASQNIRTAVAWFQQRPGQSPKLLFYLASNRHTGVPDRF TGSGSGTDFTLTINDVQSEDLADYFCLQHWNYPYTFGSGTK LEMKRTVAAPSVFIFPPSDEQLKSGTASVVCLLNNFYPREAK VQWKVDNALQSGNSQESVTEQDSKDSTYSLSSTLTLSKADY EKHKVYACEVTHQGLSSPVTKSFNRGEC | 569 |
| | Heavy Chain 2 BCMB519 | MAWVWTLLFLMAAAQSIQAEIVLTQSPGTLSLSPGERATLS CRASQSISSSFLTWYQQKPGQAPRLLIYGASSRATGIPDRFSG GGSGTDFTLTISRLEPEDFAVYYCQHYGSSPMYTFGQGTKL EIKGGSEGKSSGSGSESKSTGGSEVQLLESGGGLVQPGGSLR LSCAASGFTFSSYAMSWVRQAPGKGLEWVSAISGSGGSTYY ADSVKGRFTISRDNSKNTLYLQMNSLRAEDTAVYYCAKDE GYSSGHYYGMDVWGQGTTVTVSSEPKSSDKTHTCPPCPAP EAAGGPSVFLFPPKPKDTLMISRTPEVTCVVVSVSHEDPEVK FNWYVDGVEVHNAKTKPREEQYNSTYRVVSVLTVLHQDW LNGKEYKCKVSNKALPAPIEKTISKAKGQPREPQVYVLPPSR EEMTKNQVSLLCLVKGFYPSDIAVEWESNGQPENNYLTWPP VLDSDGSFFLYSKLTVDKSRWQQGNVFSCSVMHEALHNHY TQKSLSLSPG | 559 |
| B17B627 ZWA: Va10.2-TRVAB2-Fab-RF ZWB: | Heavy Chain 1 Va10.2-TRVAB2 | MAWVWTLLFLMAAAQSIQAEVQLQQSGPELVKPGASVKM SCKASGYTFTRYVIHWMKQKPGQGLEWIGYVNPYNNGTKY TEKFKGKATLTSDKSSSTAYMELNSLTSEDSAVYYCARPRL SGEDAMEYWGQGTSVTVSSASTKGPSVFPLAPSSKSTSGGT AALGCLVKDYFPEPVTVSWNSGALTSGVHTFPAVLQSSGLY SLSSVVTVPSSSLGTQTYICNVNHKPSNTKVDKKVEPKSCDK | 570 |

TABLE 20-continued

Sequences of antibodies expressed in CHO cells

| Bispecific Antibody | Chain info | Amino Acid Sequence | SEQ ID NO: |
|---|---|---|---|
| BCMB519-scFv | | THTCPPCPAPEAAGGPSVFLFPPKPKDTLMISRTPEVTCVVV SVSHEDPEVKFNWYVDGVEVHNAKTKPREEQYNSTYRVVS VLTVLHQDWLNGKEYKCKVSNKALPAPIEKTISKAKGQPRE PQVYVYPPSREEMTKNQVSLTCLVKGFYPSDIAVEWESNGQ PENNYKTTPPVLDSDGSFALVSKLTVDKSRWQQGNVFSCSV MHEALHNRFTQKSLSLSPG | |
| | Light Chain 1 Va10.2-TRVAB2 | MAWVWTLLFLMAAAQSIQADIQMTQSPKSMSMSVGERVT LTCKASENVVTYVSWYQQKPEQSPKLLIYGASNRYTGVPDR FTGSGSATDFTLTISSVQAEDLAEYHCGQSHSFPYTFGSGTK LELKRTVAAPSVFIFPPSDEQLKSGTASVVCLLNNFYPREAK VQWKVDNALQSGNSQESVTEQDSKDSTYSLSSTLTLSKADY EKHKVYACEVTHQGLSSPVTKSFNRGEC | 571 |
| | Heavy Chain 2 BCMB519 | MAWVWTLLFLMAAAQSIQAEIVLTQSPGTLSLSPGERATLS CRASQSISSSFLTWYQQKPGQAPRLLIYGASSRATGIPDRFSG GGSGTDFTLTISRLEPEDFAVYYCQHYGSSPMYTFGQGTKL EIKGGSEGKSSGSGSESKSTGGSEVQLLESGGGLVQPGGSLR LSCAASGFTFSSYAMSWVRQAPGKGLEWVSAISGSGGSTYY ADSVKGRFTISRDNSKNTLYLQMNSLRAEDTAVYYCAKDE GYSSGHYYGMDVWGQGTTVTVSSEPKSSDKTHTCPPCPAP EAAGGPSVFLFPPKPKDTLMISRTPEVTCVVVSVSHEDPEVK FNWYVDGVEVHNAKTKPREEQYNSTYRVVSVLTVLHQDW LNGKEYKCKVSNKALPAPIEKTISKAKGQPREPQVYVLPPSR EEMTKNQVSLLCLVKGFYPSDIAVEWESNGQPENNYLTWPP VLDSDGSFFLYSKLTVDKSRWQQGNVFSCSVMHEALHNHY TQKSLSLSPG | 559 |

The antibodies were initially purified by MabSelect SuRe Protein A column (GE healthcare, Piscataway, New Jersey) (Brown, Bottomley et al. 1998). The column was equilibrated with Phosphate Buffer Saline (PBS), pH 7.2 and loaded with fermentation supernatant at a flow rate of 2 mL/min. After loading, the column was washed with PBS (4 CV) followed by elution in 30 mM sodium acetate, pH 3.5. Fractions containing protein peaks as monitored by Absorbance at 280 nm in AKTA Explorer (GE healthcare) were pooled together and were neutralized to pH 5.0 by adding 1% of 3 M sodium acetate, pH 9.0. As a polishing step, the antibodies were purified on a preparative size exclusion chromatography (SEC) using a SUPERDEX 200 column (GE healthcare). The integrity of the sample was assessed by endotoxin measurement and SDS polyacrylamide gel electrophoresis under reducing and non-reducing conditions. The intact mass was confirmed by mass spectrometry.

TABLE 21

Anti-Vβ17 and Anti-BCMA Heavy and Light Chain Sequences

| mAb name | Chain info | Amino Acid Sequence | SEQ ID NO: |
|---|---|---|---|
| B17B663 | Heavy Chain | MAWVWTLLFLMAAAQSIQADVQLQESGPGLVAPSQSLSITCTVSG FSLSSYAISWVRQPPGKGLEWLGVIWAGGGTNYNSALKSRLSISK DNSKSQVFLKMKSLQTDDTARYYCARNFFYDYDDGMDYWGQG TTVTVSSASTKGPSVFPLAPSSKSTSGGTAALGCLVKDYFPEPVTV SWNSGALTSGVHTFPAVLQSSGLYSLSSVVTVPSSSLGTQTYICNV NHKPSNTKVDKKVEPKSCDKTHTCPPCPAPELLGGPSVFLFPPKPK DTLMISRTPEVTCVVVDVSHEDPEVKFNWYVDGVEVHNAKTKPR EEQYNSTYRVVSVLTVLHQDWLNGKEYKCKVSNKALPAPIEKTIS KAKGQPREPQVYTLPPSREEMTKNQVSLTCLVKGFYPSDIAVEWE SNGQPENNYKTTPPVLDSDGSFFLYSKLTVDKSRWQQGNVFSCSV MHEALHNHYTQKSLSLSPGK | 572 |
| | Light Chain | MARSALLILALLLLGLFSPGAWGNTQMNQTPLSLPVSLGDQASISC RSSQSLVHSNGNTYLHWYLQKPGQSPKLLIYKVSNRFSGVPDRFS GSGSGTDFTLKINRVEAEDLGVYFCSQSTHVPLTFGAGTRLEIKRT VAAPSVFIFPPSDEQLKSGTASVVCLLNNFYPREAKVQWKVDNAL QSGNSQESVTEQDSKDSTYSLSSTLTLSKADYEKHKVYACEVTHQ GLSSPVTKSFNRGEC | 573 |
| B17B694 | Heavy Chain | MAWVWTLLFLMAAAQSIQAQIQLVQSGPELKKPGETVKISCKAS GYTFTNYGMNWVKQAPGKGLKWMGWINTYTGEPTYADDFKGR FAFSLETSASTAYLQINNLKNEDMATYFCARPYFGDYAMDYWGQ GTLVTVSAASTKGPSVFPLAPSSKSTSGGTAALGCLVKDYFPEPVT VSWNSGALTSGVHTFPAVLQSSGLYSLSSVVTVPSSSLGTQTYICN VNHKPSNTKVDKKVEPKSCDKTHTCPPCPAPELLGGPSVFLFPPKP KDTLMISRTPEVTCVVVDVSHEDPEVKFNWYVDGVEVHNAKTKP REEQYNSTYRVVSVLTVLHQDWLNGKEYKCKVSNKALPAPIEKTI SKAKGQPREPQVYTLPPSREEMTKNQVSLTCLVKGFYPSDIAVEW | 574 |

TABLE 21-continued

Anti-Vβ17 and Anti-BCMA Heavy and Light Chain Sequences

| mAb name | Chain info | Amino Acid Sequence | SEQ ID NO: |
|---|---|---|---|
| | | ESNGQPENNYKTTPPVLDSDGSFFLYSKLTVDKSRWQQGNVFSCS VMHEALHNHYTQKSLSLSPGK | |
| | Light Chain | MARSALLILALLLLGLFSPGAWGDVQMIQSPASLSVSVGETVTITC RASENIYSNLAWYQQKQGKSPQVLVYTATNLADGVPSRFSGSGS GTQYSLKINSLQSEDFGSYYCQHFWGNPWTFGGGTKLEIKRTVAA PSVFIFPPSDEQLKSGTASVVCLLNNFYPREAKVQWKVDNALQSG NSQESVTEQDSKDSTYSLSSTLTLSKADYEKHKVYACEVTHQGLS SPVTKSFNRGEC | 575 |
| B17B698 | Heavy Chain | MAWVWTLLFLMAAAQSIQAQVQLQQSGPGLVAPSQSLSITCTVS GFSLTSYAISWIRQPPGKGLEWLGIIWAGGGTNYNSALKSRLSISK DNSKSQVFLKMNSLQIDDTARYYCARNPFYDYDEGLDYWGQGTT LTVSSASTKGPSVFPLAPSSKSTSGGTAALGCLVKDYFPEPVTVSW NSGALTSGVHTFPAVLQSSGLYSLSSVVTVPSSSLGTQTYICNVNH KPSNTKVDKKVEPKSCDKTHTCPPCPAPELLGGPSVFLFPPKPKDT LMISRTPEVTCVVVDVSHEDPEVKFNWYVDGVEVHNAKTKPREE QYNSTYRVVSVLTVLHQDWLNGKEYKCKVSNKALPAPIEKTISKA KGQPREPQVYTLPPSREEMTKNQVSLTCLVKGFYPSDIAVEWESN GQPENNYKTTPPVLDSDGSFFLYSKLTVDKSRWQQGNVFSCSVM HEALHNHYTQKSLSLSPGK | 576 |
| | Light Chain | MARSALLILALLLLGLFSPGAWGDIVMTQSPLSLPVSLGDQASISC RSSQSLVHSNGNTYLHWYLQKPGQSPKLLIYKVSNRFSGVPDRFS GSGSGTDFTLKISRVEAEDLGVYFCSQSTHVPWTFGGGTKLEIKRT VAAPSVFIFPPSDEQLKSGTASVVCLLNNFYPREAKVQWKVDNAL QSGNSQESVTEQDSKDSTYSLSSTLTLSKADYEKHKVYACEVTHQ GLSSPVTKSFNRGEC | 577 |
| B17B733 | Heavy Chain | MAWVWTLLFLMAAAQSIQAQVQLKESGPVLVAPSQSLSITCTVSG FSLTSYGVHWIRQPPGKGLEWLGVIWAGGNTNYNSTLMSRLSISK DNSKSQVFLKMNSLQTDDTAMYYCARGSFYDYLYFDYWGQGTT LTVSSASTKGPSVFPLAPSSKSTSGGTAALGCLVKDYFPEPVTVSW NSGALTSGVHTFPAVLQSSGLYSLSSVVTVPSSSLGTQTYICNVNH KPSNTKVDKKVEPKSCDKTHTCPPCPAPELLGGPSVFLFPPKPKDT LMISRTPEVTCVVVDVSHEDPEVKFNWYVDGVEVHNAKTKPREE QYNSTYRVVSVLTVLHQDWLNGKEYKCKVSNKALPAPIEKTISKA KGQPREPQVYTLPPSREEMTKNQVSLTCLVKGFYPSDIAVEWESN GQPENNYKTTPPVLDSDGSFFLYSKLTVDKSRWQQGNVFSCSVM HEALHNHYTQKSLSLSPGK | 578 |
| | Light Chain | MARSALLILALLLLGLFSPGAWGDIQMTQSPSYLAASPGETITINCR ASKSISKYLAWYQEKPGKTNELLIYSGSTLQSGIPSRFSGSGSGTDF TLTISSLEPEDFAMYYCQQHNEYPLTFGGGTKLEIKRTVAAPSVFIF PPSDEQLKSGTASVVCLLNNFYPREAKVQWKVDNALQSGNSQES VTEQDSKDSTYSLSSTLTLSKADYEKHKVYACEVTHQGLSSPVTK SFNRGEC | 579 |

Figure 11:
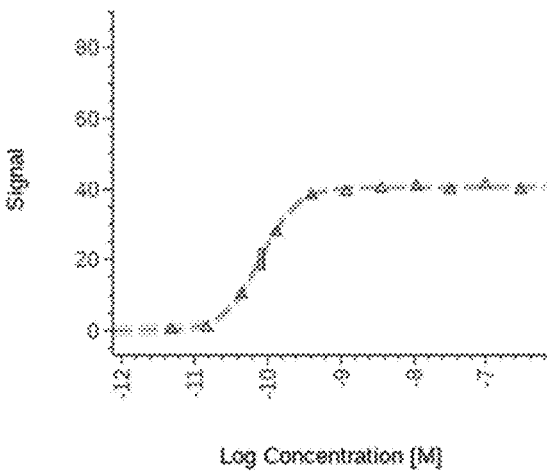
FIG. 11 shows that the Vβ17 antibody (Vb17_202B4D1-Fab-RF, BCMB519-scFv (B17B622.001)) binds T cells (left panel) and mediates T cell cytotoxicity against BCMA expressing H929 cells in vitro (right panel). $EC_{50}$ values were calculated as described in methods. Representative data shown here are from a single experiment.
Figure 12:
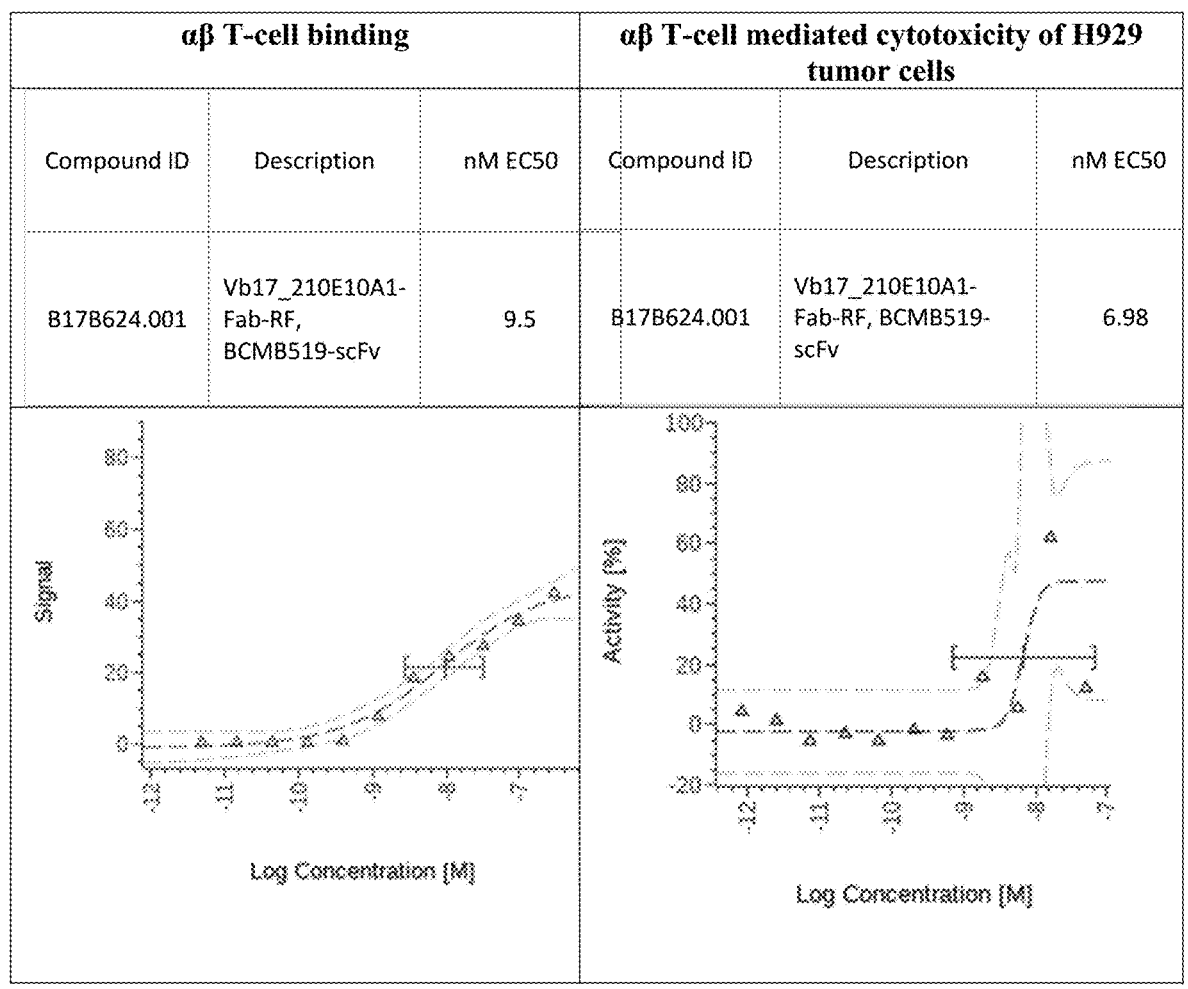
FIG. 12 shows that the Vβ17 antibody (Vb17_210E10A1-Fab-RF, BCMB519-scFv (B17B624.001)) binds T cells (left panel) and mediates T cell cytotoxicity against BCMA expressing H929 cells in vitro (right panel). $EC_{50}$ values were calculated as described in methods. Representative data shown here are from a single experiment.

Example 4.4: Evaluation of Binding and Cytotoxic Properties of the Anti-Vβ17/Anti-BCMA Bispecific Antibody Using H929 Cells and Human T Cells FIG. 11 shows that the VB17 antibody (Vb17_202B4D1-Fab-RF, BCMB519-scFv (B17B622.001)) binds T cells (left panel) and mediates T cell cytotoxicity against BCMA expressing H929 cells in vitro (right panel). FIG. 12 shows that the VB17 antibody (Vb17_210E10A1-Fab-RF, BCMB519-scFv (B17B624.001)) binds T cells (left panel) and mediates T cell cytotoxicity against BCMA expressing H929 cells in vitro (right panel). FIG. 13 shows that the control antibody (B21M-Fab-RF×BCMB519-LH-scFv (B17B612.001)) does not bind T cells (left panel) and does not mediate T cell cytotoxicity against BCMA expressing H929 cells in vitro (right panel). $EC_{50}$ values were calculated as described in methods. Representative data shown in these figures are from a single experiment. For the binding assays, αβ-enriched T cells were used, and samples incubated for 1 hour at 37° C. prior to measurements. For the killing assays, human pan T cells (effectors) were co-cultured with H929 at 5:1 E:T ratios in the presence of various concentrations of the bispecific antibody for 72 hours at 37° C. Bispecific constructs were tested in 11-point titration curve with a 3-fold dilution series starting at 50 nM antibody concentration. Human pan T cells were used as effector cells. H929-WT tumor cell line was used as target cells. Dose response curves show anti-Vβ17/anti-BCMA bispecific mediated T cell cytotoxicity against BCMA expressing H929 cells in a dose dependent manner.

Figure 14:
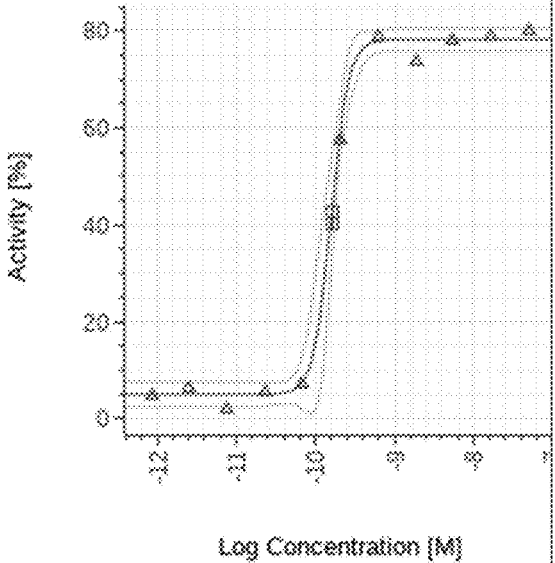
FIG. 14 shows that the Vα10.2 antibody (Vα10.2-TRVAB1-Fab-RF×BCMB519-scFv (B17B621.001)) activates T cell (right panel) and mediates T cell cytotoxicity against BCMA expressing H929 cells in vitro (left panel). $EC_{50}$ values were calculated as described in methods. Representative data shown here are from a single experiment.

Example 4.5: Evaluation of Cytotoxicity Properties of the Anti-Vα10.2/Anti-BCMA Bispecific Antibody FIG. 14 shows that the Vα10.2 antibody (Vα10.2-TRVAB1-Fab-RF, BCMB519-scFv (B17B621.001)) mediates T cell cytotoxicity against BCMA expressing H929 cells in vitro (left panel), and expression level of T cell activation marker CD25 (right panel). The killing assays protocol is as follows: human pan T cells (effectors) were co-cultured with H929 at 5:1 E:T ratios in the presence of various concentrations of the bispecific antibody for 72 hours at 37° C. Bispecific constructs were tested in 11-point titration curve with a 3-fold dilution series starting at 50 nM antibody concentration. Human pan T cells were used as effector cells. H929-WT tumor cell line was used as target cells.

Figure 15:
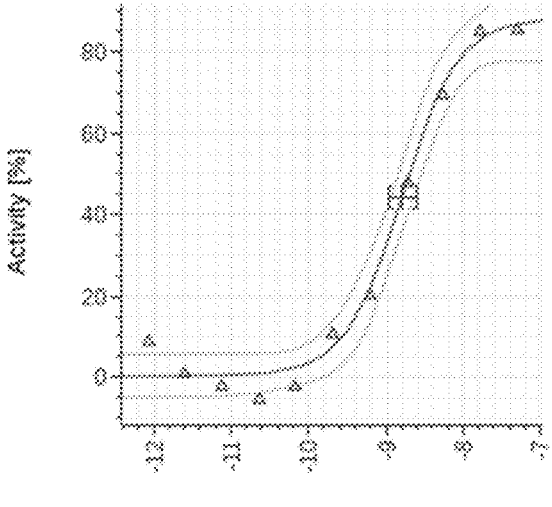
FIG. 15 shows that the Vα10.2 antibody (Vα10.2-TRVAB2-Fab-RF×BCMB519-scFv (B17B627.001)) activates T cell (right panel) and mediates T cell cytotoxicity against BCMA expressing H929 cells in vitro (left panel). $EC_{50}$ values were calculated as described in methods. Representative data shown here are from a single experiment.

FIG. 15 shows that the Vα10.2 antibody (Vα10.2-TRVAB2-Fab-RF, BCMB519-scFv (B17B627.001)) mediates T cell cytotoxicity against BCMA expressing H929 cells in vitro (left panel), and expression level of T cell activation marker CD25 (right panel). The killing assays protocol is as follows: human pan T cells (effectors) were co-cultured with H929 at 5:1 E:T ratios in the presence of various concentrations of the bispecific antibody for 72 hours at 37° C. Bispecific constructs were tested in 11-point titration curve with a 3-fold dilution series starting at 50 nM antibody concentration. Human pan T cells were used as effector cells. H929-WT tumor cell line was used as target cells.

Example 5—Bispecific Antibodies that Bind Vβ17 and DLL3

Example 5.1: Generation of Anti-DLL3 Antibodies and Scfv

Antibody generation using transgenic mice (Ablexis®). The preparation and use of Ablexis®, and the genomic modifications carried by such mice, is described in WO11/123708. Ablexis mice were immunized with recombinant human DLL3 protein (DL3W35, PPB0000199808, SEQ ID NO:688). Lymphocytes were extracted from secondary lymphoid organs and either fused with FO mouse myeloma cell line for hybridoma generation or subjected to single cell sorting via fluorescence-activated cell sorting (FACS). Hybridoma supernatants were screened by Meso Scale Discovery (MSD) electrochemiluminescence for binding to over-expressing human DLL3 ECD HEK cells. Identified samples were further assayed for binding to over-expressing human DLL3 ECD HEK cells (positive signal) compared to parental HEK cells (negative signal) via FACS. Single cell sorting supernatants were screened by MSD electrochemiluminescence for binding to recombinant human DLL3 protein. Approximately >300 samples were identified to be DLL3 binders. The binding of >300 anti-hDLL3 supernatant samples to human DLL3 protein was measured by single cycle kinetics method by Biacore 8K SPR.

```
>SEQ ID NO: 688, Recombinant human DLL3 (27-479)
C-6xHis, HPGGGSGGGSGGGS (SEQ ID NO: 689) Linker
AGVFELQIHSFGPGPGPGAPRSPCSARLPCRLFFRVCLKPGLSEEAAESP

CALGAALSARGPVYTEQPGAPAPDLPLPDGLLQVPFRDAWPGTFSFIIET

WREELGDQIGGPAWSLLARVAGRRRLAAGGPWARDIQRAGAWELRFSYRA

RCEPPAVGTACTRLCRPRSAPSRCGPGLRPCAPLEDECEAPLVCRAGCSP

EHGFCEQPGECRCLEGWTGPLCTVPVSTSSCLSPRGPSSATTGCLVPGPG

PCDGNPCANGGSCSETPRSFECTCPRGFYGLRCEVSGVTCADGPCFNGGL

CVGGADPDSAYICHCPPGFQGSNCEKRVDRCSLQPCRNGGLCLDLGHALR

CRCRAGFAGPRCEHDLDDCAGRACANGGTCVEGGGAHRCSCALGFGGRDC

RERADPCAARPCAHGGRCYAHFSGLVCACAPGYMGARCEFPVHPDGASAL

PAAHPGGGSGGGSGGGSHHHHHH
```

Selected positive binders were moved forward for V-region cloning and converted to scFv in both VH-VL and VL/VH orientation.

V Region Cloning. V-regions of heavy and light chains from hybridoma supernatants containing positive binders for human DLL3 were cloned and sequenced. mRNA was isolated from hybridoma samples. Both RNA purified by Qiagen kit (RNEASY PLUS Mini Kit) and B cells lysate were used for cDNA synthesis using the SMARTER cDNA synthesis kit (Clontech, Mount View, CA). To facilitate cDNA synthesis, oligodT was used to prime reverse transcription of all messenger RNAs followed by "5' capping" with a SMARTER IIA oligonucleotide. Subsequent amplification of the VH and VL fragments was performed using a 2-step PCR amplification using 5' primers targeting the SMARTER IIA cap and 3' primers targeting consensus regions in CH1. Briefly, each 50 µl PCR reaction consisted of 20 µM of forward and reverse primer mixes, 25 µl of PRIMESTAR MAX DNA polymerase premix (Clontech), 2 µl of unpurified cDNA, and 21 µl of double-distilled H2O. The cycling program started at 94° C. for 3 min, followed by 35 cycles (94° C. for 30 secs, 55° C. for 1 min, 68° C. for 1 min), and ended at 72° C. for 7 min. The second round PCR was performed with VL and VH second round primers containing 15 bp complementary extensions that "overlap" respective regions in their respective Lonza mother vector (VH and VL). The second round PCR was performed with the following program: 94° C. for 3 min; 35 cycles (94° C. for 30 Sec, 55° C. for 1 min, 68° C. for 1 min), and ends at 72° C. for 7 min. In-Fusion® HD Cloning Kit (Clonetech) was used for directional cloning of VL gene into Lonza huIgK or Lambda vector and VH gene into Lonza huIgG1 vector. To facilitate In-Fusion® HD Cloning, PCR products were treated with Cloning Enhancer before In-Fusion® HD Cloning. Cloning and transformation were performed according to manufacturer's protocol (Clonetech). Miniprep DNAs were subjected to Sanger sequencing to confirm that complete V-gene fragments were obtained.

scFv and scFv-Fc formatting. Following cloning of the variable regions, the VH and VL sequences were used to generate antibodies. Antibodies were expressed in a Fab format, a mAb format, a scFv format in the VH-linker-VL orientation or a scFv format in VL-linker-VH orientation and were further analyzed as described below. The linker sequence (GGSEGKSSGSGSESKSTGGS) of SEQ ID NO:690 was used to conjugate the VH/VL regions.

The wild-type IgG1 Fc domain with the sequence described below was fused to the anti-DLL3 scFv to create the scFv-Fc molecules:

```
>SEQ ID NO: 691
EPKSCDKTHTCPPCPAPELLGGPSVFLFPPKPKDTLMISRTPEVTCVVVD

VSHEDPEVKFNWYVDGVEVHNAKTKPREEQYNSTYRVVSVLTVLHQDWLN

GKEYKCKVSNKALPAPIEKTISKAKGQPREPQVYTLPPSREEMTKNQVSL

TCLVKGFYPSDIAVEWESNGQPENNYKTTPPVLDSDGSFFLYSKLTVDKS

RWQQGNVFSCSVMHEALHNHYTQKSLSLSPG
```

ExpiCHO-S™ Transfection and Purification of Anti-DLL3 Antibodies.

Protein Expression & Cell Culture: The anti-DLL3 scFv-Fc fusion proteins were expressed in ExpiCHO-S™ cells (ThermoFisher Scientific) by transient transfection with purified plasmid DNA encoding the proteins following the manufacturer's recommendations. Briefly, ExpiCHO-S™ cells were maintained in suspension in ExpiCHO™ expression medium (ThermoFisher Scientific) in an orbital shaking incubator set at 37° C., 8% CO₂ and 125 RPM. The cells were passaged and diluted prior to transfection to 6.0×106 cells per ml, maintaining cell viability at 99.0% or better. Transient transfections were done using the Expi-Fectamine™ CHO transfection kit (ThermoFisher Scientific, Cat #A29131). For each ml of diluted cells to be transfected, 0.5 microgram of scFv-Fc fusion encoding DNA and 0.5 microgram of pAdVAntage DNA (Promega, Cat #E1711) was used and diluted into OptiPRO™ SFM complexation medium. ExpiFectamine™ CHO reagent was used at a 1:4 ratio (v/v, DNA:reagent) and diluted into OptiPRO™. The diluted DNA and transfection reagent were combined for one minute, allowing DNA/lipid complex formation, and then added to the cells. After overnight incubation, ExpiCHO™ feed and ExpiFectamine™ CHO enhancers were added to the cells as per the manufacturer's Standard protocol. Cells were incubated with orbital shaking (125 rpm) at 37° C. for seven days prior to harvesting the culture broth. The culture supernatant from the transiently transfected ExpiCHO-S™ cells was clarified by centrifugation (30 min, 3000rcf) followed by filtration (0.2 µm PES membrane, Corning; Corning, NY).

Protein Purification: The filtered cell culture supernatant was loaded onto a pre-equilibrated (1×DPBS, pH 7.2) Mab-Select Sure Protein A column (GE Healthcare) using an AKTAXpress chromatography system. After loading, the column was washed with 10 column volumes of 1×DPBS, pH7.2. The protein was eluted with 10 column volumes of 0.1 M sodium (Na)-Acetate, pH 3.5. Protein fractions were neutralized immediately by the addition of 2.5 M Tris HC1, pH 7.5 to 20% (v/v) of the elution fraction volume. Peak fractions were pooled and filtered (0.2 µm). The quality of the purified protein was assessed by analytical size exclusion HPLC (Agilent HPLC system). The protein was further purified by preparative size exclusion chromatography using Superdex200 resin (GE Healthcare) and 1×DPBS pH7.2 as mobile phase. The peak fractions containing monomeric protein only were pooled and filtered (0.2 µm).

Example 5.2: Structural Characterization of Anti-DLL3 Antibodies

Variable domains VH, VL and CDRs. Table 22 shows the VH and VL amino acid sequences of selected anti-DLL3 scFvs. Table 23 shows the Kabat HCDR1, HCDR2 and HCDR3 of selected anti-DLL3 selected scFvs. Table 24 shows the Kabat LCDR1, LCDR2 and LCDR3 of the selected anti-DLL3 scFvs. Table 25 shows the protein and DNA SEQ ID NOs for the VH and VL regions.

TABLE 22

VH and VL amino acid sequences of selected anti-DLL3 (scFv) antibodies.

| mAb name | VH name | VH amino acid Sequence | VH SEQ ID NO: | VL name | VL amino acid sequence | VL SEQ ID NO: |
|---|---|---|---|---|---|---|
| DL3B279 scFv | DL3B279 scFv_VH | QVQLVQSGAEVKKP GASVKVSCKASGNT FTNYYIHWVRQAPG QGLEWMGIINPSGG STSYAQKLQGRMTM TRDTSTSTVYMELS SLRSEDTAVYFCAR QGPFIGDAFDIWGQ GTMVTVSS | 692 | DL3B279 scFv VL | DIQMTQSPSSL SASVGDRVTIT CRASQGISNYL AWFQQKPGKAP KSLIYAASSLQ SGVPSKFSGSG SGTDFTLTISS LQPEDFATYYC QQYNSYPYTFA QGTKLEIK | 693 |
| DL3B279 scFv variant | DL3B279 scFv variant_ VH | QVQLVQSGAEVKKP GASVKVSCKASGQT FTNYYIHWVRQAPG QGLEWMGIINPSGG STSYAQKLQGRMTM TRDTSTSTVYMELS SLRSEDTAVYFCAR QGPFIGDAFDIWGQ GTTVTVSS | 694 | DL3B279 scFv variant_ VL | DIQMTQSPSSL SASVGDRVTIT CRASQGISNYL AWFQQKPGKAP KSLIYAASSLQ SGVPSKFSGSG SGTDFTLTISS LQPEDFATYYC QQYNSYPYTFG QGTKLEIK | 695 |

TABLE 23

HCDR1, HCDR2 and HCDR3 amino acid sequences of selected anti-DLL3 (scFv) antibodies using Kabat delineation.

| | Kabat HCDR1 | | Kabat HCDR2 | | Kabat HCDR3 | |
|---|---|---|---|---|---|---|
| mAb name | Sequence | SEQ ID NO: | Sequence | SEQ ID NO: | Sequence | SEQ ID NO: |
| DL3B279 scFv | NYYIH | 696 | IINPSGGSTSYA QKLQG | 697 | QGPFIGDAFDI | 698 |
| DL3B279 scFv variant | NYYIH | 696 | IINPSGGSTSYA QKLQG | 697 | QGPFIGDAFDI | 698 |

TABLE 24

LCDR1, LCDR2 and LCDR3 amino acid sequences of selected anti-
DLL3 (scFv) antibodies using Kabat delineation.

| mAb name | Kabat HCDR1 Sequence | SEQ ID NO: | Kabat HCDR2 Sequence | SEQ ID NO: | Kabat HCDR3 Sequence | SEQ ID NO: |
|---|---|---|---|---|---|---|
| DL3B279 scFv | RASQGISNYLA | 699 | AASSLQS | 700 | QQYNSYPYT | 701 |
| DL3B279 scFv variant | RASQGISNYLA | 699 | AASSLQS | 700 | QQYNSYPYT | 701 |

TABLE 25

SEQ ID NOs of Protein and DNA sequences of the VH and VL
domains of selected anti-DLL3 antibodies.

| Antibody | VH Protein SEQ ID NO: | VL Protein SEQ ID NO | VH cDNA SEQ ID NO: | VL cDNA SEQ ID NO: |
|---|---|---|---|---|
| DL3B279 scFv | 692 | 693 | 702 | 703 |
| DL3B279 scFv variant | 694 | 695 | 704 | 705 |

>SEQ ID NO: 702 (DL3B279 scFv-VH cDNA)
CAGGTTCAGTTGGTCCAGAGTGGTGCCGAAGTAAAGAAGCCCGGAGCATCCGTAAAGGTGTCCTGTAA
AGCCAGTGGCAATACTTTTCACTAACTATTACATCCATTGGGTCCGACAAGCCCCCGGACAAGGATTGG
AGTGGATGGGTATTATCAACCCCTCCGGTGGGTCTACTTCTTACGCTCAAAAACTCCAGGGCCGAATG
ACAATGACACGCGACACCTCAACTTCAACCGTTTACATGGAGCTTAGCAGTCTTCGATCTGAGGACAC
TGCTGTTTACTTTTGCGCTAGGCAGGGGCCTTTCATAGGAGACGCTTTTGACATCTGGGGGCAAGGAA
CAATGGTCACTGTCAGTTCC

>SEQ ID NO: 704 (DL3B279 scFv variant-VH cDNA)
CAGGTTCAGCTGGTTCAGTCTGGCGCCGAAGTGAAGAAACCTGGCGCCTCTGTGAAGGTGTCCTGCAA
GGCTTCTGGACAGACCTTCACCAACTACTACATCCACTGGGTCCGACAGGCCCCTGGACAAGGATTGG
AGTGGATGGGCATCATCAACCCTTCCGGCGGCTCTACCTCTTACGCCCAGAAACTGCAGGGCAGAATG
ACCATGACCAGAGACACCTCCACCAGCACCGTGTACATGGAACTGTCCAGCCTGAGATCCGAGGATAC
CGCCGTGTACTTCTGTGCCAGACAGGGACCTTTTATCGGCGACGCCTTCGACATCTGGGGCCAGGGAA
CAACAGTGACCGTGTCCTCT >SEQ ID NO: 703 (DL3B279 scFv-VL cDNA)
GATATTCAGATGACACAGTCTCCATCCAGCTTGTCAGCAAGCGTGGGTGATAGGGTTACCATCACTTG
TCGCGCAAGTCAAGGAATTAGTAACTATTTGGCATGGTTTCAGCAGAAACCCGGTAAGGCTCCAAAAT
CACTCATATATGCAGCATCCTCCCTCCAGTCTGGTGTTCCAAGTAAGTTTTCCGGGAGCGGTTCCGGC
ACCGATTTCACTCTCACAATCTCTAGCCTTCAACCCGAGGACTTCGCTACCTATTATTGCCAACAGTA
TAATAGCTACCCATACACTTTTGCTCAAGGGACCAAACTCGAGATCAAA >SEQ ID NO: 705 (DL3B279 scFv variant-VL cDNA)
GACATCCAGATGACCCAGTCTCCATCCTCTCTGTCCGCCTCTGTGGGCGACAGAGTGACCATCACCTG
TAGAGCCTCTCAGGGCATCTCCAACTACCTGGCCTGGTTCCAGCAGAAGCCTGGCAAGGCTCCAAAGA
GCCTGATCTACGCTGCTTCCAGTCTGCAGTCTGGCGTGCCCTCTAAGTTCTCCGGCTCTGGCTCTGGC
ACCGACTTTACCCTGACAATCTCCAGCCTGCAGCCTGAGGACTTCGCCACCTACTACTGCCAGCAGTA
CAACAGCTACCCCTACACCTTTGGCCAGGGCACCAAGCTGGAAATCAAG Fab-Fc and scFvs. The DLL3 specific VH/VL regions were engineered as VH-CH1-linker CH2-CH3 and VL-CL and expressed as IgG1, IgG2 or IgG4 or were engineered as scFvs in either the VH-Linker-VL or VL-linker-VH orientations. The linker that is used in the scFv was GGSEGKSSGSGSESKSTGGS (SEQ ID NO:706). The scFv were used to generate bispecific antibodies as described in Example 5.4.

TABLE 26

Amino acid sequences of the variable domain of selected anti-DLL3
scFvs antibodies in VL-linker-VH (LH) format.

| scFv name | Acronym | Amino acid sequence | SEQ ID NO: |
|---|---|---|---|
| scFv1 | DL3B279 scFv_LH | DIQMTQSPSSLSASVGDRVTITCRASQGISNYLAWFQ QKPGKAPKSLIYAASSLQSGVPSKFSGSGSGTDFTLT ISSLQPEDFATYYCQQYNSYPYTFAQGTKLEIKGGSE GKSSGSGSESKSTGGSQVQLVQSGAEVKKPGASVKVS CKASGNTFTNYYIHWVRQAPGQGLEWMGIINPSGGST | 707 |

TABLE 26-continued

Amino acid sequences of the variable domain of selected anti-DLL3 scFvs antibodies in VL-linker-VH (LH) format.

| scFv name | Acronym | Amino acid sequence | SEQ ID NO: |
|---|---|---|---|
| | | SYAQKLQGRMTMTRDTSTSTVYMELSSLRSEDTAVYF CARQGPFIGDAFDIWGQGTMVTVSS | |
| scFv2 | DL3B279 scFv_LH (variant) | DIQMTQSPSSLSASVGDRVTITCRASQGISNYLAWFQ QKPGKAPKSLIYAASSLQSGVPSKFSGSGSGTDFTLT ISSLQPEDFATYYCQQYNSYPYTFGQGTKLEIKGGSE GKSSGSGSESKSTGGSQVQLVQSGAEVKKPGASVKVS CKASGQTFTNYYIHWVRQAPGQGLEWMGIINPSGGST SYAQKLQGRMTMTRDTSTSTVYMELSSLRSEDTAVYF CARQGPFIGDAFDIWGQGTTVTVSS | 708 |
| scFv8 | DL3B279 scFv_HL | QVQLVQSGAEVKKPGASVKVSCKASGNTFTNYYIHWV RQAPGQGLEWMGIINPSGGSTSYAQKLQGRMTMTRDT STSTVYMELSSLRSEDTAVYFCARQGPFIGDAFDIWG QGTMVTVSSGGSEGKSSGSGSESKSTGGSDIQMTQSP SSLSASVGDRVTITCRASQGISNYLAWFQQKPGKAPK SLIYAASSLQSGVPSKFSGSGSGTDFTLTISSLQPED FATYYCQQYNSYPYTFAQGTKLEIK | 709 |
| scFv9 | DL3B279 scFv variant_HL | QVQLVQSGAEVKKPGASVKVSCKASGQTFTNYYIHWV RQAPGQGLEWMGIINPSGGSTSYAQKLQGRMTMTRDT STSTVYMELSSLRSEDTAVYFCARQGPFIGDAFDIWG QGTTVTVSSGGSEGKSSGSGSESKSTGGSDIQMTQSP SSLSASVGDRVTITCRASQGISNYLAWFQQKPGKAPK SLIYAASSLQSGVPSKFSGSGSGTDFTLTISSLQPED FATYYCQQYNSYPYTFGQGTKLEIK | 710 |

The DNA sequences of the variable domain of selected anti-DLL3 scFv antibodies in VL-linker-VH (LH) format are listed below.

>DL3B279-scFv-LH DNA;
SEQ ID NO: 711
GATATACAAATGACTCAAAGTCCCTCTAGTCTCAGTGCTTCCGTTGGGGA
TAGGGTAACTATCACTTGCCGCGCTAGTCAAGGCATCTCAAATTATTTGG
CATGGTTCCAACAGAAGCCTGGTAAGGCACCAAAATCACTCATCTACGCT
GCTAGTTCTCTGCAATCAGGTGTGCCATCCAAATTCTCAGGCAGTGGGTC
TGGGACAGACTTTACCCTCACCATAAGTTCTCTCCAACCTGAGGATTTTG
CAACATACTATTGTCAGCAGTATAATAGTTATCCATACACATTCGCACAA
GGTACTAAACTGGAAATCAAGGGCGGCTCCGAGGGCAAGAGCAGCGGCAG
CGGCAGCGAGAGCAAGAGCACCGGCGGCAGCCAAGTTCAACTTGTCCAAA
GTGGAGCTGAAGTGAAGAAACCAGGGGCAAGCGTCAAAGTATCATGTAAA
GCCAGCGGAAACACTTTCACCAACTACTACATTCATTGGGTAAGGCAGGC
ACCAGGACAAGGCTTGGAATGGATGGGTATTATAAACCCTTCAGGTGGCA
GTACATCCTATGCCCAAAAACTGCAAGGTCGGATGACCATGACTCGTGAC
ACTTCAACTTCTACTGTTTATATGGAGCTTTCATCCCTGCGATCCGAAGA
TACAGCCGTGTATTTTTGTGCTCGCCAGGGGCCTTTCATCGGAGATGCCT
TCGATATATGGGGTCAAGGCACAATGGTAACTGTGTCAAGC

>DL3B279-scFv-LH variant DNA;
SEQ ID NO: 712
GACATCCAGATGACCCAGTCTCCATCCTCTCTGTCCGCCTCTGTGGGCGA
CAGAGTGACCATCACCTGTAGAGCCTCTCAGGGCATCTCCAACTACCTGG
CCTGGTTCCAGCAGAAGCCTGGCAAGGCTCCCAAGAGCCTGATCTACGCT
GCTTCCAGTCTGCAGTCTGGCGTGCCCTCTAAGTTCTCCGGCTCTGGCTC
TGGCACCGACTTTACCCTGACAATCTCCAGCCTGCAGCCTGAGGACTTCG
CCACCTACTACTGCCAGCAGTACAACAGCTACCCCTACACCTTTGGCCAG
GGCACCAAGCTGGAAATCAAGGGCGGCTCCGAGGGCAAGAGCAGCGGCAG
CGGCAGCGAGAGCAAGAGCACCGGCGGCAGCCAGGTTCAGCTGGTTCAGT
CTGGCGCCGAAGTGAAGAAACCTGGCGCCTCTGTGAAGGTGTCCTGCAAG
GCTTCTGGACAGACCTTCACCAACTACTACATCCACTGGGTCCGACAGGC
CCCTGGACAAGGATTGGAGTGGATGGGCATCATCAACCCTTCCGGCGGCT
CTACCTCTTACGCCCAGAAACTGCAGGGCAGAATGACCATGACCAGAGAC
ACCTCCACCAGCACCGTGTACATGGAACTGTCCAGCCTGAGATCCGAGGA
TACCGCCGTGTACTTCTGTGCCAGACAGGGACCTTTTATCGGCGACGCCT
TCGACATCTGGGGCCAGGGAACAACAGTGACCGTGTCCTCT

Example 5.3: Preparation of Anti-DLL3/Anti-Vβ17 Bispecific Antibodies

The anti-DLL3/anti-Vβ17 antibody was generated by co-expression of the anti-Vb17 knob heavy chain and light chain (LC) with the anti-DLL3 heavy chain B. The anti-Vb17 with humanized variable region further modified by mutation of N33S in the light chain CDR1 variable domain to remove a deamidation risk was used to generate the bispecific antibodies.

The parent anti-DLL3 variable region was discovered by immunizing transgenic Ablexis® mice with recombinant human DLL3 protein, respectively. The parent anti-DLL3 variable region, featured in the DL3B279 mAb, contained sequence liabilities. Specifically, in the variable heavy domain contained a germline mutation at N27, which is normally tyrosine in the IGHV1-46*03 germline. However, since this residue was near the CDR, it was mutated to an amino acid with a similar sidechain, glutamine (N27Q). Additionally, Met105 in the joining region was mutated to Thr (M105T). The light chain v-region from DL3B279 featured a germline mutation at A99 which was mutated back to Gly (A99G). Together, mutation of N27Q and M105T in the variable heavy domain and A99G in the variable light domain gave rise to the final variable region featured in the anti-DLL3/anti-Vβ17 bispecific antibody. This variable region was formatted as a single-chain fragment variable (scFv) in the final molecule.

The designed heavy chain molecules were synthesized into gblocks (IDT; Coralville, IA) containing 15 bp overlaps at the 5' and 3' ends for ligation independent cloning using InFusion® method (ClonTech). All light chain constructs were inserted into pLonza vector containing the BswiI and HindIII restriction sites for in-frame ligation to the human kappa constant domain. Murine IgH signal peptides were encoded to allow for efficient secretion of mAbs into culture supernatant. All gblocks were reconstituted in sterile water and incubated at 50° C. for 10 minutes as per manufacturer protocol. pLonza vector (Lonza; Basel, Switzerland) was linearized using EcoRI and HindIII followed by gel extraction and cleanup. A 2:1 mass ratio of linearized vector to insert was used followed by heat pulse at 50° C. for 15 minutes. The infusion reactions were transformed into Stellar competent cells (ClonTech) and resultant colonies were scaled for miniprep. All constructs were sequence verified and scaled up using Endotoxin free maxi preparation kits (Qiagen; Hilden, Germany).

The VH amino acid sequence of the Vβ17 antibody used is SEQ ID NO: 21. The VL amino acid sequences of the Vβ17 antibody used is SEQ ID NO: 23 and SEQ ID NO: 677. The VH and VL nucleotide sequences of the anti-Vβ17 antibodies are listed below.

>Vb17-v2-B17B21-Fab VH DNA;
SEQ ID NO: 713
CAAGTGCAGCTTCAGGAATCTGGACCCGGATTGGTTAAGCCCAGTGAAAC
CCTCAGTTTGACCTGTACTGTGAGCGGTTATTCCATAACTAGCGGCTACT
TCTGGAATTGGATCCGACAGCCTCCAGGTAAAGGGCTTGAGTGGATTGGC
TACATTAGCTACGATGGCTCCAACAACTATAATCCAAGTTTGAAAAGTAG
AGTGACCATCAGCAGAGATACTTCCAAAAATCAGTTCAGTCTTAAACTTA

GCTCCGTGACAGCCGCCGACACAGCCGTTTACTACTGTGCAAGCCCATCT
CCAGGTACTGGATATGCCGTAGATTATTGGGGACAAGGTACTCTTGTGAC
TGTGTCCAGT

>Vb17-v2-B17B21-Fab VL DNA;
SEQ ID NO: 714
GACATCCAGATGACCCAGAGCCCCAGCAGCCTGTCTGCCAGCGTGGGCGA
CAGAGTGACCATCACCTGTCGGAGCAGCCAGAGCCTGGTGCACAGCAACG
GCAACACCTACCTGCACTGGTATCAGCAGAAGCCCGGCAAGGCCCCCAAG
TTCCTGATCTACAAGGTGTCCAACCGGTTCAGCGGCGTGCCCAGCAGATT
TTCTGGCAGCGGCTCCGGCACCGACTTCACCCTGACAATCAGCTCCCTGC
AGCCCGAGGACTTCGCCACCTACTACTGCAGCCAGTCCACCCACGTGCCC
TTCACCTTTGGCCAGGGCACCAAGCTGGAAATCAAG

>Vb17-LC-N335-Fab VH DNA;
SEQ ID NO: 715
CAGGTTCAGCTGCAAGAGTCTGGCCCTGGCCTGGTCAAGCCTTCCGAGAC
ACTGTCTCTGACCTGCACCGTGTCCGGCTACTCTATCACCAGCGGCTACT
TTTGGAACTGGATCCGGCAGCCTCCTGGCAAAGGCCTGGAATGGATCGGC
TACATCTCCTACGACGGCTCCAACAACTACAACCCCAGCCTGAAGTCCAG
AGTGACCATCTCTCGGGACACCTCCAAGAACCAGTTCTCCCTGAAGCTGT
CCTCCGTGACCGCTGCTGATACCGCCGTGTACTACTGCGCCTCTCCTTCT
CCTGGCACCGGCTACGCTGTGGATTATTGGGGACAGGGCACCCTCGTGAC
CGTGTCATCT

>Vb17-LC-N33S-Fab VL DNA;
SEQ ID NO: 716
GACATCCAGATGACCCAGTCTCCATCCTCTCTGTCCGCCTCTGTGGGCGA
CAGAGTGACCATCACCTGTCGGTCCTCTCAGTCCCTGGTGCACTCTTCCG
GCAACACCTACCTGCACTGGTATCAGCAGAAGCCCGGCAAGGCCCCTAAG
TTCCTGATCTACAAGGTGTCCAACCGGTTCTCCGGCGTGCCCTCCAGATT
TTCTGGCTCTGGATCTGGCACCGACTTTACCCTGACAATCTCCAGCCTGC
AGCCTGAGGACTTCGCCACCTACTACTGCTCCCAGTCTACCCACGTGCCA
TTCACCTTTGGCCAGGGCACCAAGCTGGAAATCAAG

TABLE 27

Kabat CDR Sequences/SEQ ID NOs of bispecific anti-DLL3/anti-vβ17 antibodies

| Bispecific antibody name | Parental (DLL3 arm/ vb17 arm) | HCDR1 | HCDR2 | HCDR3 | LCDR1 | LCDR2 | LCDR3 |
|---|---|---|---|---|---|---|---|
| DL3B588 | DL3B279-LH-scFv | 696 | 697 | 698 | 699 | 700 | 701 |
|  | Vb17_v2-B17B21-Fab | SGYFWN SEQ ID NO: 717) | 236 | 237 | 680 | 239 | 240 |
| D3VBB1 | DL3B279-LH-scFV variant | 696 | 697 | 698 | 699 | 700 | 701 |
|  | Vb17-LC-N33S-Fab | SGYFWN SEQ ID NO: 717) | 236 | 237 | 680 | 239 | 240 |

TABLE 28

HC and LC amino acid
sequences of anti-DLL3/anti-Vβ17 antibodies.

| Bispecific Name | DLL3 arm | | Vβ17 arm | | |
|---|---|---|---|---|---|
| | Name | HC1 or scFv-Fc SEQ ID NO: | LC1 SEQ ID NO: | Name | HC2 or scFv-Fc SEQ ID NO: | LC2 SEQ ID NO: |
| DL3B588 | DL3B279-LH-scFv-Fc | 718 | N/A | Vb17_v2-B17B21-Fab | 720 | 721 |
| D3VBB1 | DL3B279-VL-A99G-VH-N27Q | 719 | N/A | Vb17-LC-N33S-Fab | 722 | 723 |
| | M105T-LH-scFV-Fc (variant) | | | | | |

TABLE 29

HC2 and LC2 amino acid sequences of the Vβ17 arm of selected anti-DLL3/anti-vβ17 antibodies.

| Name | HC2 amino acid Sequence | HC2 SEQ ID NO: | LC2 amino acid sequence | LC2 SEQ ID NO: |
|---|---|---|---|---|
| Vb17_v2-B17B21-Fab | QVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG | 720 | DIQMTQSPSSLSASVGDRVTITCRSSQSLVHSNGNTYLHWYQQKPGKAPKFLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE | 721 |
| Vb17-LC-N33S-Fab | QVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK | 722 | DIQMTQSPSSLSASVGDRVTITCRSSQSLVHSSGNTYLHWYQQKPGKAPKFLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC | 723 |

TABLE 30

HC1 amino acid sequences of the DLL3 binding arm of selected DLL3-Vβ17 antibodies.

| Name | HC1 amino acid Sequence | SEQ ID NO |
|---|---|---|
| DL3B279-LH-scFv-Fc | DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFAQGTKLEIKGGSEGKSSGSGSESKSTGGSQVQLVQSGAEVKKPGASVKVSCKASGNTFTNYYIHWVRQAPGQGLEWMGIINPSGGSTSYAQKLQGRMTMTRDTSTSTVYMELSSLRSEDTAVYFCARQGPFIGDAFDIWGQGTMVTVSSEPKSSDKTHTCPPCPAPEAAGGPSVFLEPPKPK | 718 |

TABLE 30-continued

HC1 amino acid sequences of the DLL3 binding arm of selected DLL3-Vβ17 antibodies.

| Name | HC1 amino acid Sequence | SEQ ID NO |
|---|---|---|
| DL3B279-VL-A99G-VH-N27Q_M105T-LH-scFV-Fc (variant) | DTLMISRTPEVTCVVVSVSHEDPEVKFNWYVDGVEVHNAKTKPREEQYNSTYRVVS VLTVLHQDWLNGKEYKCKVSNKALPAPIEKTISKAKGQPREPQVYVLPPSREEMTK NQVSLLCLVKGFYPSDIAVEWESNGQPENNYLTWPPVLDSDGSFELYSKLTVDKSR WQQGNVFSCSVMHEALHNHYTQKSLSLS DIQMTQSPSSLSASVGDRVTITCRASQGISNYLAWFQQKPGKAPKSLIYAASSLQS GVPSKFSGSGSGTDFTLTISSLQPEDFATYYCQQYNSYPYTFGQGTKLEIKGGSEG KSSGSGSESKSTGGSQVQLVQSGAEVKKPGASVKVSCKASGQTFTNYYIHWVRQAP GQGLEWMGIINPSGGSTSYAQKLQGRMTMTRDTSTSTVYMELSSLRSEDTAVYFCA RQGPFIGDAFDIWGQGTTVTVSSEPKSSDKTHTCPPCPAPEAAGGPSVFLEPPKPK DTLMISRTPEVTCVVVSVSHEDPEVKFNWYVDGVEVHNAKTKPREEQYNSTYRVVS VLTVLHQDWLNGKEYKCKVSNKALPAPIEKTISKAKGQPREPQVYVLPPSREEMTK NQVSLLCLVKGFYPSDIAVEWESNGQPENNYLTWPPVLDSDGSFELYSKLTVDKSR WQQGNVFSCSVMHEALHNHYTQKSLSLSPGK | 719 |

TABLE 31

HC and LC DNA sequences of anti-DLL3/anti-Vβ17 antibodies.

| | DLL3 arm | | | Vβ17 arm | | |
|---|---|---|---|---|---|---|
| Bi-specific Name | Name | HC1 or scFv-Fc SEQ ID NO: | LC1 SEQ ID NO: | Name | HC2 or scFv-Fc SEQ ID NO: | LC2 SEQ ID NO: |
| DL3B588 | DL3B279-LH-scFv-Fc | 724 | NA | Vb17_v2-B17B21-Fab | 726 | 727 |
| D3VBB1 | DL3B279-VL-A99G-VH-N27Q_M105T-LH-scFV-Fc (variant) | 725 | N/A | Vb17-LC-N33S-Fab | 728 | 729 |

>SEQ ID NO: 724 (DL3B279 LH scFv-Fc cDNA)
GATATTCAGATGACACAGTCTCCATCCAGCTTGTCAGCAAGCGTGGGTGATAGGGTTACCATCACTTG
TCGCGCAAGTCAAGGAATTAGTAACTATTTGGCATGGTTTCAGCAGAAACCCGGTAAGGCTCCAAAAT
CACTCATATATGCAGCATCCTCCCTCCAGTCTGGTGTTCAAGTAAGTTTTCCGGGAGCGGTTCCGGC
ACCGATTTCACTCTCACAATCTCTAGCCTTCAACCCGAGGACTTCGCTACCTATTATTGCCAACAGTA
TAATAGCTACCCATACACTTTTGCTCAAGGGACCAAACTCGAGATCAAAGGCGGCTCCGAGGGCAAGA
GCAGCGGCAGCGGCAGCGAGAGCAAGAGCACCGGCGGCAGCCAGGTTCAGTTGGTCCAGAGTGGTGCC
GAAGTAAAGAAGCCCGGAGCATCCGTAAAGGTGTCCTGTAAAGCCAGTGGCAATACTTTCACTAACTA
TTACATCCATTGGGTCCGACAAGCCCCCGGACAAGGATTGGAGTGGATGGGTATTATCAACCCCTCCG
GTGGGTCTACTTCTTACGCTCAAAAACTCCAGGGCGAATGACAATGACACGCGACACCTCAACTTCA
ACCGTTTACATGGAGCTTAGCAGTCTTCGATCTGAGGACACTGCTGTTTACTTTTGCGCTAGGCAGGG
GCCTTTTCATAGGAGACGCTTTTGACATCTGGGGCAAGGAACAATGGTCACTGTCAGTTCCGAGCCCA
AATCTAGCGACAAAACTCACACATGTCCACCGTGCCCAGCACCTGAAGCAGCAGGGGACCGTCAGTC
TTCCTCTTCCCCCCAAAACCCAAGGACACCCTCATGATCTCCCGGACCCCTGAGGTCACATGCGTGGT
GGTGAGCGTGAGCCACGAAGACCCTGAGGTCAAGTTCAACTGGTACGTGGACGGCGTGGAGGTGCATA
ATGCCAAGACAAAGCCGCGGGAGGAGCAGTACAACAGCACGTACCGTGTGGTCAGCGTCCTCACCGTC
CTGCACCAGGACTGGCTGAATGGCAAGGAGTACAAGTGCAAGGTCTCCAACAAAGCCCTCCCAGCCCC
CATCGAGAAAACCATCTCCAAAGCCAAAGGGCAGCCCCGAGAACCACAGGTGTACGTGCTGCCCCCAT
CCCGGGAGGAGATGACCAAGAACCAGGTCAGCCTGCTGTGCCTGGTCAAAGGCTTCTATCCCAGCGAC
ATCGCCGTGGAGTGGGAGAGCAATGGGCAGCCGGAGAACAACTACCTCACCTGGCCTCCCGTGCTGGA
CTCCGACGGCTCCTTCTTCCTCTACAGCAAGCTCACCGTGGACAAGTCTAGATGGCAGCAGGGGAACG
TCTTCTCATGCTCCGTGATGCATGAGGCTCTGCACAACCACTACACGCAGAAGAGCCTCTCCCTGTCT
CCGGGT

>SEQ ID NO: 725 (DL3B279 LH scFv variant-Fc cDNA)
GACATCCAGATGACCCAGTCTCCATCCTCTCTGTCCGCCTCTGTGGGCGACAGAGTGACCATCACCTG
TAGAGCCTCTCAGGGCATCTCCAACTACCTGGCCTGGTTCCAGCAGAAGCCTGGCAAGGCTCCCAAGA
GCCTGATCTACGCTGCTTCCAGTCTGCAGTCTGGCGTGCCCTCTAAGTTCTCCGGCTCTGGCTCTGGC
ACCGACTTTACCCTGACAATCTCCAGCCTGCAGCCTGAGGACTTCGCCACCTACTACTGCCAGCAGTA
CAACAGCTACCCCTACACCTTTGGCCAGGGCACCAAGCTGGAAATCAAGGGCGGCTCCGAGGGCAAGA
GCAGCGGCAGCGGCAGCGAGAGCAAGAGCACCGGCGGCAGCCAGGTTCAGCTGGTTCAGTCTGGCGCC
GAAGTGAAGAAACCTGGCGCCTCTGTGAAGGTGTCCTGCAAGGCTTCTGGACAGACCTTCACCAACTA
CTACATCCACTGGGTCCGACAGGCCCCTGGACAAGGATTGGAGTGGATGGGCATCATCAACCCTTCCG
GCGGCTCTACCTCTTACGCCCAGAAACTGCAGGGCAGAATGACCATGACCAGAGACACCTCCACCAGC
ACCGTGTACATGGAACTGTCCAGCCTGAGATCCGAGGATACCGCCGTGTACTTCTGTGCCAGACAGGG
ACCTTTTATCGGCGACGCCTTCGACATCTGGGGCCAGGGAACAACAGTGACCGTGTCCTCTGAGCCCA
AATCTAGCGACAAAACTCACACTTGTCCACCGTGCCCAGCACCTGAAGCAGCAGGGGACCGTCAGTC
TTCCTCTTCCCCCCAAAACCCAAGGACACCCTCATGATCTCCCGGACCCCTGAGGTCACATGCGTGGT
GGTGAGCGTGAGCCACGAAGACCCTGAGGTCAAGTTCAACTGGTACGTGGACGGCGTGGAGGTGCATA TABLE 31-continued HC and LC DNA sequences of anti-DLL3/anti-Vβ17 antibodies.

ATGCCAAGACAAAGCCGCGGGAGGAGCAGTACAACAGCACGTACCGTGTGGTCAGCGTCCTCACCGTC
CTGCACCAGGACTGGCTGAATGGCAAGGAGTACAAGTGCAAGGTGTCCAACAAAGCCCTCCCAGCCCC
CATCGAGAAAACCATCTCCAAAGCCAAAGGGCAGCCCCGAGAACCACAGGTGTACGTGCTGCCCCCAT
CCCGGGAGGAGATGACCAAGAACCAGGTCAGCCTGCTGTGCCTGGTCAAAGGCTTCTATCCCAGCGAC
ATCGCCGTGGAGTGGGAGAGCAATGGGCAGCCGGAGAACAACTACCTCACCTGGCCTCCCGTGCTGGA
CTCCGACGGCTCCTTCTTCCTCTACAGCAAGCTCACCGTGGACAAGTCCAGATGGCAGCAGGGGAACG
TCTTCTCATGCTCCGTGATGCATGAGGCTCTGCACAACCACTACACGCAGAAGTCTCTCTCCCTGTCT
CCGGGAAAA

>SEQ ID NO: 726 (Vb17_v2-B17B21-Fab HC cDNA)
CAAGTGCAGCTTCAGGAATCTGGACCCGGGATTGGTTAAGCCCAGTGAAACCCTCAGTTTGACCTGTAC
TGTGAGCGGTTATTCCATAACTAGCGGCTACTTCTGGAATTGGATCCGACAGCCTCCAGGTAAAGGGC
TTGAGTGGATTGGCTACATTAGCTACGATGGCTCCAACAACTATAATCCAAGTTTGAAAAGTAGAGTG
ACCATCAGCAGAGATACTTCCAAAAATCAGTTCAGTCTTAAACTTAGCTCCGTGACAGCCGCCGACAC
AGCCGTTTACTACTGTGCAAGCCCATCTCCAGGTACTGGATATGCCGTAGATTATTGGGGACAAGGTA
CTCTTGTGACTGTGTCCAGTGCCTCCACCAAGGGCCCATCGGTCTTCCCCCTGGCACCCTCCTCCAAG
AGCACCTCTGGGGGCACAGCGGCCCTGGGCTGCCTGGTCAAGGACTACTTCCCCGAACCGGTGACGGT
GTCGTGGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCTGCAAC
GTGAATCACAAGCCCAGCAACACCAAGGTGGACAAGAAAGTTGAGCCCAAATCTTGTGACAAAACTCA
CACATGTCCACCGTGCCCAGCACCTGAAGCAGCAGGGGGACCGTCAGTCTTCCTCTTCCCCCCAAAAC
CCAAGGACACCCTCATGATCTCCCGGACCCCTGAGGTCACATGCGTGGTGGTGAGCGTGAGCCACGAA
GACCCTGAGGTCAAGTTCAACTGGTACGTGGACGGCGTGGAGGTGCATAATGCCAAGACAAAGCCGCG
GGAGGAGCAGTACAACAGCACGTACCGTGTGGTCAGCGTCCTCACCGTCCTGCACCAGGACTGGCTGA
ATGGCAAGGAGTACAAGTGCAAGGTCTCCAACAAAGCCCTCCCAGCCCCCATCGAGAAAACCATCTCC
AAAGCCAAAGGGCAGCCCCGAGAACCACAGGTGTACGTGTACCCCCCATCCCGGGAGGAGATGACCAA
GAACCAGGTCAGCCTGACCTGCCTGGTCAAAGGCTTCTATCCCAGCGACATCGCCGTGGAGTGGGAGA
GCAATGGGCAGCCGGAGAACAACTACAAGACCACGCCTCCCGTGCTGGACTCCGACGGCTCCTTCGCC
CTCGTGAGCAAGCTCACCGTGGACAAGTCTAGATGGCAGCAGGGGAACGTCTTCTCATGCTCCGTGAT
GCATGAGGCTCTGCACAACCACTACACGCAGAAGAGCCTCTCCCTGTCTCCGGGT

>SEQ ID NO: 727 (Vb17_v2-B17B21-Fab LC cDNA)
GACATCCAGATGACCCAGAGCCCCAGCAGCCTGTCTGCCAGCGTGGGCGACAGAGTGACCATCACCTG
TCGGAGCAGCCAGAGCCTGGTGCACAGCAACGGCAACACCTACCTGCACTGGTATCAGCAGAAGCCCG
GCAAGGCCCCCAAGTTCCTGATCTACAAGGTGTCCAACCGGTTCAGCGGCGTGCCCAGCAGATTTTCT
GGCAGCGGCTCCGGCACCGACTTCACCCTGACAATCAGCTCCCTGCAGCCCGAGGACTTCGCCACCTA
CTACTGCAGCCAGTCCACCCACGTGCCCTTCACCTTTGGCCAGGGCACCAAGCTGGAAATCAAGCGTA
CGGTGGCTGCACCATCTGTCTTCATCTTCCCGCCATCTGATGAGCAGTTGAAATCTGGAACTGCCTCT
GTTGTGTGCCTGCTGAATAACTTCTATCCCAGAGAGGCCAAAGTACAGTGGAAGGTGGATAACGCCCT
CCAATCGGGTAACTCCCAGGAGAGTGTCACAGAGCAGGACAGCAAGGACAGCACCTACAGCCTCAGCA
GCACCCTGACGCTGAGCAAAGCAGACTACGAGAAACACAAAGTCTACGCCTGCGAAGTCACCCATCAG
GGCCTGAGCTCGCCCGTCACAAAGAGCTTCAACAGGGGAGAGTGT

>SEQ ID NO: 728 (Vb17-LC-N33S-Fab HC cDNA)
CAGGTTCAGCTGCAAGAGTCTGGCCCTGGCCTGGTCAAGCCTTCCGAGACACTGTCTCTGACCTGCAC
CGTGTCCGGCTACTCTATCACCAGCGGCTACTTTTGGAACTGGATCCGGCAGCCTCCTGGCAAAGGCC
TGGAATGGATCGGCTACATCTCCTACGACGGCTCCAACAACTACAACCCCAGCCTGAAGTCCAGAGTG
ACCATCTCTCGGGACACCTCCAAGAACCAGTTCTCCCTGAAGCTGTCCTCCGTGACCGCTGCTGATAC
CGCCGTGTACTACTGCGCCTCTCCTTCTCCTGGCACCGGCTACGCTGTGGATTATTGGGGACAGGGCA
CCCTCGTGACCGTGTCATCTGCCTCCACCAAGGGTCCATCGGTCTTCCCCCTGGCACCCTCCTCCAAG
AGCACCTCTGGGGGCACAGCGGCCCTGGGCTGCCTGGTCAAGGACTACTTCCCCGAACCGGTGACGGT
GTCGTGGAACTCAGGCGCCCTGACCAGCGGCGTGCACACCTTCCCGGCTGTCCTACAGTCCTCAGGAC
TCTACTCCCTCAGCAGCGTGGTGACCGTGCCCTCCAGCAGCTTGGGCACCCAGACCTACATCTGCAAC
GTGAATCACAAGCCCAGCAACACCAAGGTGGACAAGAAAGTTGAGCCCAAATCTTGTGACAAAACTCA
CACTTGTCCACCGTGCCCAGCACCTGAAGCAGCAGGGGGACCGTCAGTCTTCCTCTTCCCCCCAAAAC
CCAAGGACACCCTCATGATCTCCCGGACCCCTGAGGTCACATGCGTGGTGGTGAGCGTGAGCCACGAA
GACCCTGAGGTCAAGTTCAACTGGTACGTGGACGGCGTGGAGGTGCATAATGCCAAGACAAAGCCGCG
GGAGGAGCAGTACAACAGCACGTACCGTGTGGTCAGCGTCCTCACCGTCCTGCACCAGGACTGGCTGA
ATGGCAAGGAGTACAAGTGCAAGGTGTCCAACAAAGCCCTCCCAGCCCCCATCGAGAAAACCATCTCC
AAAGCCAAAGGGCAGCCCCGAGAACCACAGGTGTACGTGTACCCCCCATCCCGGGAGGAGATGACCAA
GAACCAGGTCAGCCTGACCTGCCTGGTCAAAGGCTTCTATCCCAGCGACATCGCCGTGGAGTGGGAGA
GCAATGGGCAGCCGGAGAACAACTACAAGACCACGCCTCCCGTGCTGGACTCCGACGGCTCCTTCGCC
CTCGTGAGCAAGCTCACCGTGGACAAGTCCAGATGGCAGCAGGGGAACGTCTTCTCATGCTCCGTGAT
GCATGAGGCTCTGCACAACCACTACACGCAGAAGTCTCTCTCCCTGTCTCCGGGAAAA

>SEQ ID NO: 729 (Vb17-LC-N33S-Fab cDNA)
GACATCCAGATGACCCAGAGCCCCAGCAGCCTGTCTGCCAGCGTGGGCGACAGAGTGACCATCACCTG
TCGGAGCAGCCAGAGCCTGGTGCACAGCTCTGGCAACACCTACCTGCACTGGTATCAGCAGAAGCCCG
GCAAGGCCCCCAAGTTCCTGATCTACAAGGTGTCCAACCGGTTCAGCGGCGTGCCCAGCAGATTTTCT
GGCAGCGGCTCCGGCACCGACTTCACCCTGACAATCAGCTCCCTGCAGCCCGAGGACTTCGCCACCTA
CTACTGCAGCCAGTCCACCCACGTGCCCTTCACCTTTGGCCAGGGCACCAAGCTGGAAATCAAGCGTA
CGGTGGCTGCACCATCTGTCTTCATCTTCCCGCCATCTGATGAGCAGTTGAAATCTGGAACTGCCTCT
GTTGTGTGCCTGCTGAATAACTTCTATCCCAGAGAGGCCAAAGTACAGTGGAAGGTGGATAACGCCCT
CCAATCGGGTAACTCCCAGGAGAGTGTCACAGAGCAGGACAGCAAGGACAGCACCTACAGCCTCAGCA
GCACCCTGACGCTGAGCAAAGCAGACTACGAGAAACACAAAGTCTACGCCTGCGAAGTCACCCATCAG
GGCCTGAGCTCGCCCGTCACAAAGAGCTTCAACAGGGGAGAGTGT

Example 5.4: Characterization of Anti-DLL3/Anti-Vβ17 Bispecific Antibodies

Bispecific DLL3×Vβ17 mediated cytotoxicity against DLL3+ target cell lines in pan-T cells. Two DLL3+ cell lines, HCC1833 (~12,000 DLL3/cell) and G361(~6,000 DLL3/cell), were used, at two different Effector to Target ratios (E:T):10:1 and 5:1. HCC1833 (a lung adenocarcinoma cell line) and G361 (a malignant melanoma cell line) both express DLL3+ and were thus chosen as target cell lines. HCC1833 can express approximately twice as many DLL3+ antigens on its surface. On day 0 of the experiment, four xCelligence plates were blanked with 50 µl of growth media. Two of the four Celligence plates were then seeded with 40,000 HCC1833 (50 µl out of 0.8×106/ml) cells per well, and the other two plates were seeded with 20,000 G361 (50 µl out of 0.4×106/ml) cells per well. These plates were then incubated on the xCelligence machine overnight. On day 1 of the experiment, one PAN-T donor was used to prepare the different E:T ratios. 50 µl of 8×106/ml PAN-T cells (400,000 cells) was added into one HCC1833 plate and 50 µl of 4×106/ml PAN-T cells (200,000 cells) was added into the other HCC1833 plate. One G361 plate received 50 µl of 4×106/ml of PAN-T was added into one G361 plate and 50 µl of 2×106/ml of PAN-T was added into the other G361 plate (200,000 and 100,000 cells, respectively). Then 50 µl of the bispecific anti-DLL3×Vβ17 antibodies were added to the appropriate wells for each plate. Six wells were assigned as tumor cells only to be used for normalization in the percent cytolysis calculation. The final bispecific antibody concentrations were 150 nM, 50 nM, 16.7 nM, 5.5 nM, 1.8 nM and 0 nM, respectively. The plates were then placed in the xCelligence machine and impedance was recorded every 15 minutes for 120 hours. The percent cytolysis was calculated on the RTCA software The total number of Vβ17 in each well and its corresponding E:T ratio in each well is also included in Table 32.

TABLE 32

E:T ratios of PAN-T to Tumor tested in DLL3 expressing cell lines

| | Tumor Cells/well | PAN-T/ well | ~5% Vβ17 + cells/well | E (Vβ17):T | E (PAN-T):T |
|---|---|---|---|---|---|
| HCC1833 Condition 1 | 40,000 | 200,000 | 10,000 | 0.25:1 | 5:1 |
| HCC1833 Condition 2 | 40,000 | 400,000 | 20,000 | 0.5:1 | 10:1 |
| G361 Condition 1 | 20,000 | 100,000 | 5,000 | 0.25:1 | 5:1 |
| G361 Condition 1 | 20,000 | 200,000 | 10,000 | 0.5:1 | 10:1 |

Figure 16A:
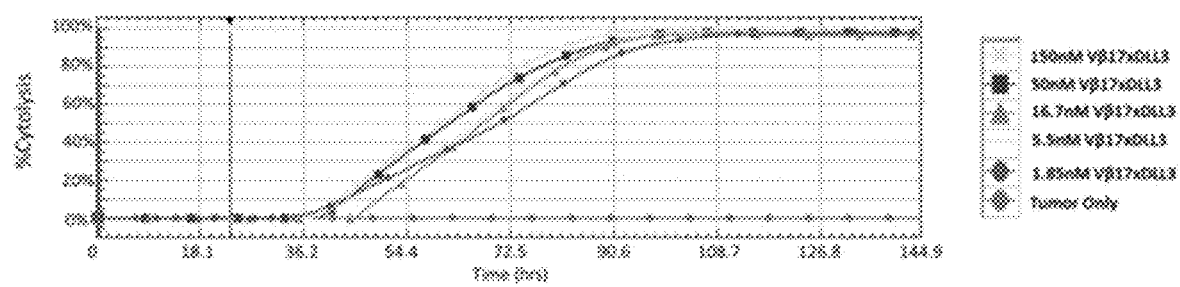
FIGS. 16A-16B show the evaluation of the cell cytolysis mediated by various concentrations of anti-DLL3×Vβ17 antibodies under different E:T ratios of PAN-T:Tumor and Vβ17:Tumor relative to HCC1833 cells only.
Figure 16B:
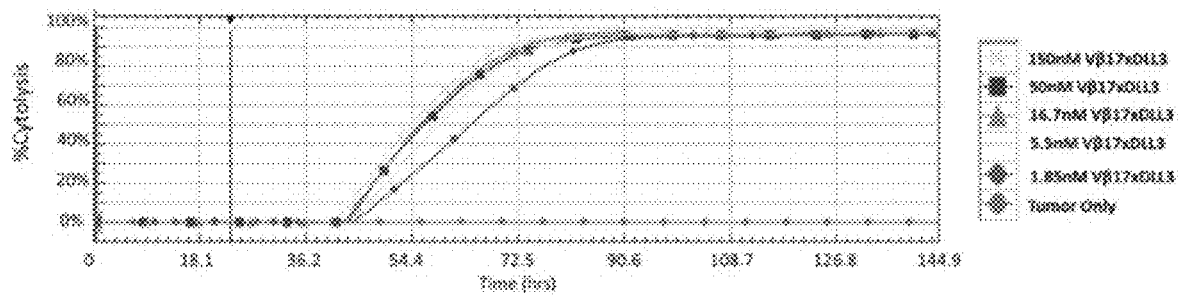
Figure 17A:
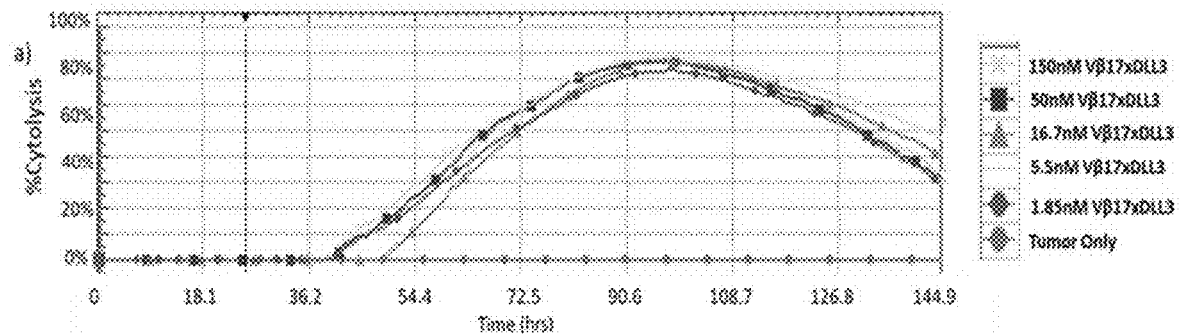
FIGS. 17A-17B show the evaluation of the cell cytolysis mediated by various concentrations of anti-DLL3×Vβ17 antibodies under different E:T ratios of PAN-T:Tumor and Vβ17:Tumor relative to G361 cells only.
Figure 17B:
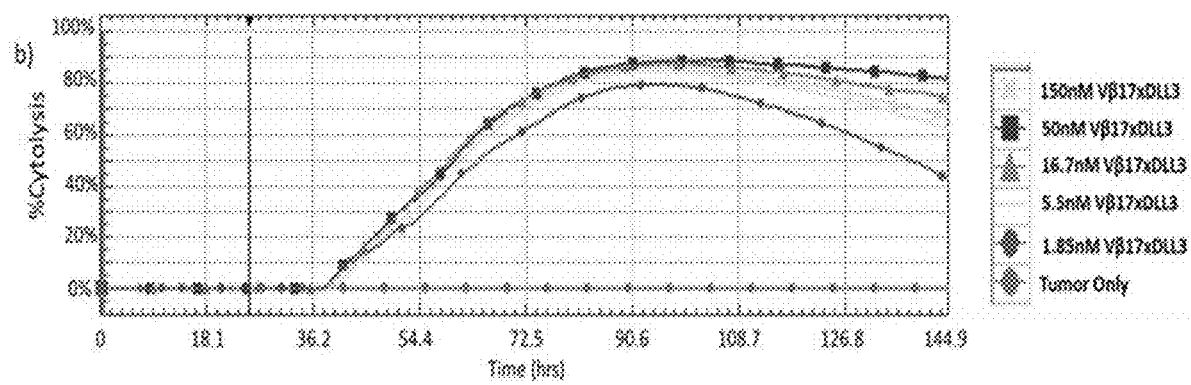

As shown in FIGS. 16A and 16B, the percent cytolysis of the different concentrations of anti-DLL3×Vβ17 antibodies were calculated based on tumor cells only (HCC1833). All different concentrations of the bispecific anti-DLL3×Vβ17 antibody (D3VBB1) reached 100% cytolysis within 85 hours and 67 hours of the co-culture with HCC1833 and PAN-T cells at 5:1 and 10:1 E:T ratios, respectively. A dose response was observed for Vβ17×DLL3 vertical line at approximately 23 hours, representing the beginning of the co-culture of the T cells, the bispecific antibodies and the tumor cells. As shown in FIGS. 17A and 17B, the percent cytolysis of the different concentrations of anti-DLL3×Vβ17 (D3VBB1) were also calculated relative to tumor cells only (G361). No dose response was observed for Vβ17×DLL3 when a) PAN-T:Tumor 5:1; Vβ17:Tumor 0.25:1 and b) PAN-T:Tumor 10:1; Vβ17:Tumor 0.5:1.

Bispecific anti-DLL3×Vβ17 mediated cytotoxicity against DLL3 target cell lines in PBMCs. To test the efficacy of anti-DLL3×VB17 antibodies in cytotoxic activity against DLL3 expressing target cells, the time course analysis of tumor cell lysis at various effector to target (ET) ratios was carried out. Cells with high DLL3 expression (SHP-77 and HCC1833) and low DLL3 expression (G361) were both tested. DLL3+ SHP77 cell line stably expressing the nuclear restricted NucLight Red (NLR) protein was used in the cytotoxicity assay. On the day of the assay, SHP-77-NLR cells were collected into a 50 ml falcon tube and spun down at 1300 rpm for 5 min. The cell pellet was then resuspended in modified RPMI 1640 media+10% FBS (complete media) and cell count was estimated using trypan blue live dead marker by a hemocytometer. SHP77-NLR cells were then plated onto a collagen coated 96-well plate at 10,000 cells/well/90W of complete media. The cells were evenly distributed by gentle agitation and allowed to settle for 1 hour in a 5% $CO_2$ incubator. In the case of HCC1833 and G361 target cell lines, 3000 cells/well/90 µl complete media were plated in a 96-well tissue culture plates one day prior to the PBMC addition.

Figure 18A:
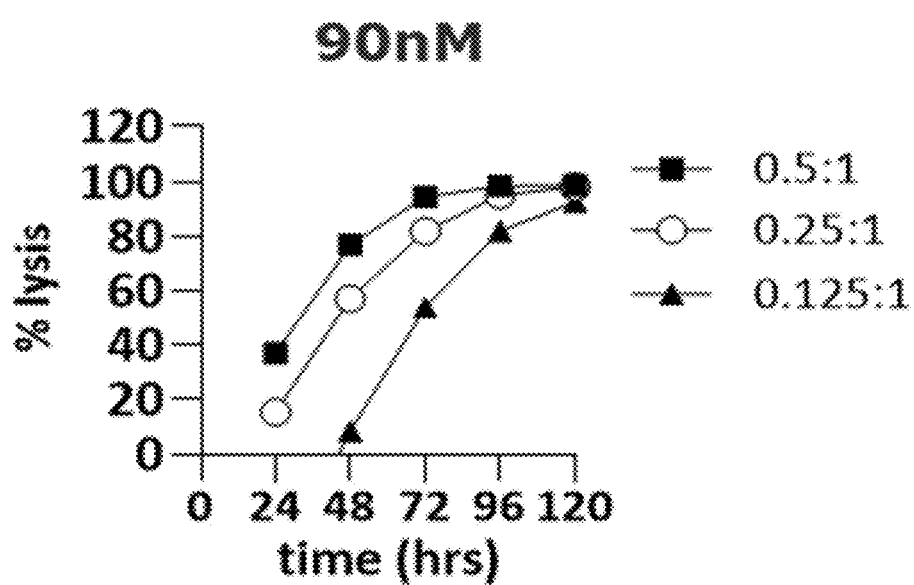
FIGS. 18A-18C show the cytotoxicity mediated by bispecific anti-DLL3×Vβ17 antibodies.
Figure 18B:
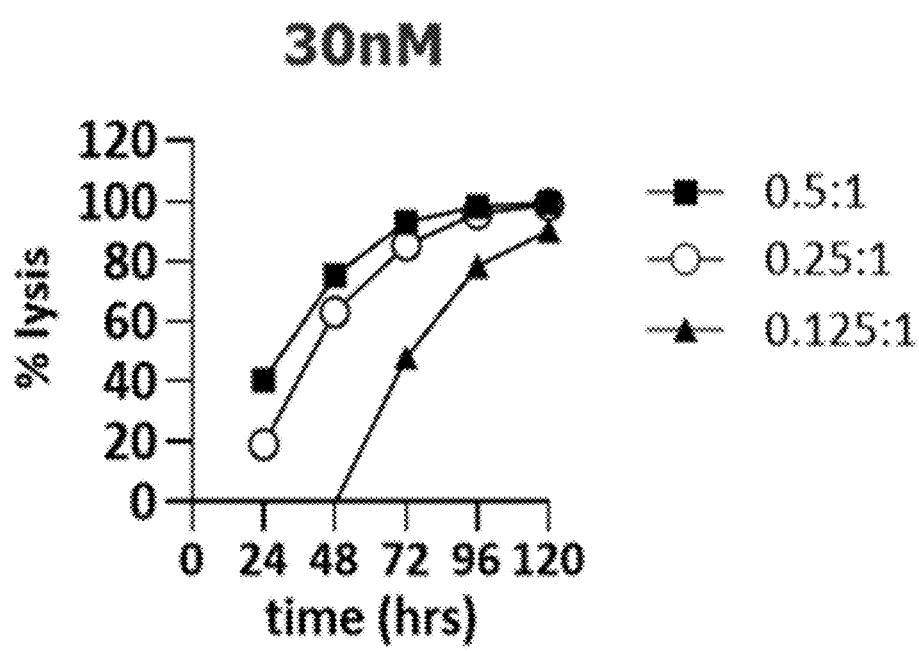
Figure 18C:
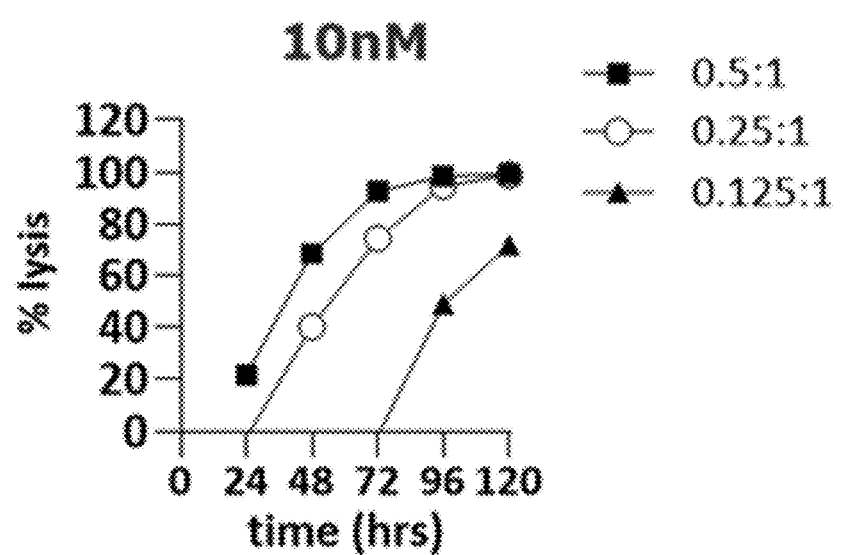

Vials of PBMCs frozen from healthy donors (Clinigene) were rapidly thawed in a 37° C. water bath, transferred to a 15 mL conical tube, and washed once with 10 mL complete medium. The cells were stained with anti-human Vβ17 antibody and analyzed by flow cytometer to determine the Vβ17% within PBMCs. The PBMCs from each donor were counted using trypan blue live dead marker by a hemocytometer. Appropriate numbers of PBMCs required to get effector to target (ET) ratios of 0.5:1, 0.25:1 and 0.125:1 (Vβ17:target cell) were added to the plated target cells in 90 µl complete media. The test antibodies were then prepared as 10× stocks in complete media and 3-fold serial dilutions were prepared. The serially diluted test antibodies were added to the PBMC-tumor coculture at 20 µl/well until the final concentration of antibody became 1×. Wells with no antibody (NBS) were used as control for the basal cytotoxicity. The plates were placed in an INCUCYTE S3® (Essen BioScience) at 37° C. with 5% $CO_2$ for 120 hours. An increase in red signal corresponds to target cell proliferation and a decrease in signal corresponds to target cell death. % lysis was calculated as ={100−(red signal intensity at a specific time point with Antibody/red signal intensity at that time point in NBS wells)*100}. Each point on the graph represents an average of 3 donors. The results are shown in FIGS. 18A-18C.

TABLE 33

Percent lysis of HCC1833 and G361 cells on day 5 after coculture with whole PBMCs and anti-DLL3x Vβ17 antibody at 30 nM at the indicated E:T ratios (Vβ17: target cells).

| | | Cytotoxicity (% Lysis at Day 5) | | |
|---|---|---|---|---|
| | Materials | E:T = 1:1 | E:T = 0.5:1 | E:T = 0.25:1 |
| Cell line | Anti-DLL3xVβ17 antibody | 30 nM | 30 nM | 30 nM |
| HCC1833 | DL3B588 | 99.9 | 99.7 | 96.8 |
| G361 | DL3B588 | 99.1 | 95.9 | 90.8 |

Plates were scanned for up to 120 hours in an IncuCyte S3® (Essen BioScience) in a 37° C. with 5% $CO_2$ incubator. Percent lysis was calculated as the difference between the red signal intensity at a specific time point with antibody divided by the red signal intensity at that time point in NBS wells. Each value represents an average of 2 donors (HPU-15088 and HPU-15098). Potent cytotoxicity was observed with bispecific anti-DLL3×Vβ17 antibody. Significant target cell lysis was observed at low ET ratios also. Target cell lysis was delayed at low ET ratios but reached 100% at later time points. Efficacy of bispecific anti-DLL3×Vβ17 antibody was seen on both high DLL3 expression (SHP-77 and HCC1833) and low DLL3 expression (G361) cell lines as shown in FIGS. 18A-18B.

Proliferation of Vβ17+ T cells in response to DLL3× Vβ17 antibody in whole PBMC cytotoxicity assay. Vβ17 T cells constitute approximately 2-5% of T cells in human PBMCs. To test if the binding of the bispecific antibody induces proliferation and expansion of the Vβ17 T cells, percentage of Vβ17 T cells undergoing proliferation and the total number of Vβ17 T cells in the culture were determined. DLL3$^+$ SHP77 cell line stably expressing the nuclear restricted NucLight Red (NLR) protein was used in the cytotoxicity assay. On the day of the assay, SHP-77-NLR cells were collected into a 50 ml falcon tube and spun down at 1300 rpm for 5 min. The cell pellet was then resuspended in 1 ml modified RPMI 1640 media+10% FBS (complete media) and cell count was estimated using trypan blue live dead marker using a hemocytometer. SHP77-NLR cells were then plated onto a collagen coated plate 96 well plate at 10,000 cells/well/90W of complete media. The cells were evenly distributed by gentle agitation and allowed to settle for 1 hour in a 5% $CO_2$ incubator.

Vials of PBMCs frozen from healthy donors (Clinigene) were rapidly thawed in a 37° C. water bath, transferred to a 15 mL conical tube, and washed once with 10 mL complete medium. The cells were stained with anti-human Vβ17 antibody and analyzed by flow cytometer to determine the Vβ17% within PBMCs. PBMCs were stained Cell Trace Violet dye (C34571, Thermo Fisher Scientific). PBMCs from each donor were counted using trypan blue live dead marker using a hemocytometer. Appropriate number of PBMCs required to get effector to target (ET) ratio of 0.5:1 (VB17:target cell) were added to the plated target cells in 90 ul complete media. The test antibodies were prepared as 10× stocks in complete media and 3-fold serial dilutions were prepared from the starting concentration for a total of 3 dilution points. The serially diluted test antibodies were added to the PBMC-tumor coculture at 20 μl/well so that the final concentration of antibody became 1×. Wells with no antibody (NBS) were used as control for the basal cytotoxicity. The plates were incubated in a 5% $CO_2$ incubator for the indicated time periods.

Figure 19A:
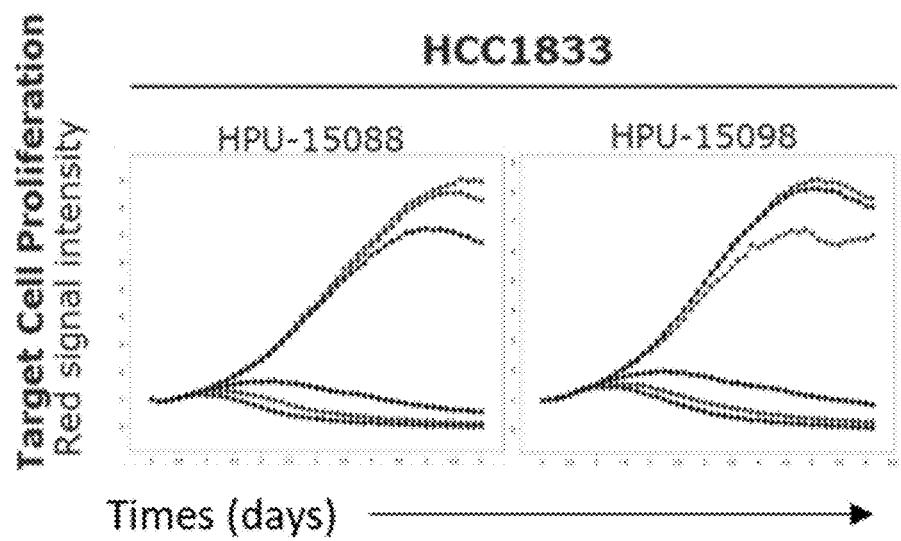
FIGS. 19A-19B show the cytotoxicity mediated by bispecific anti-DLL3×Vβ17 antibody against DLL3 expressing target cells.
Figure 19B:
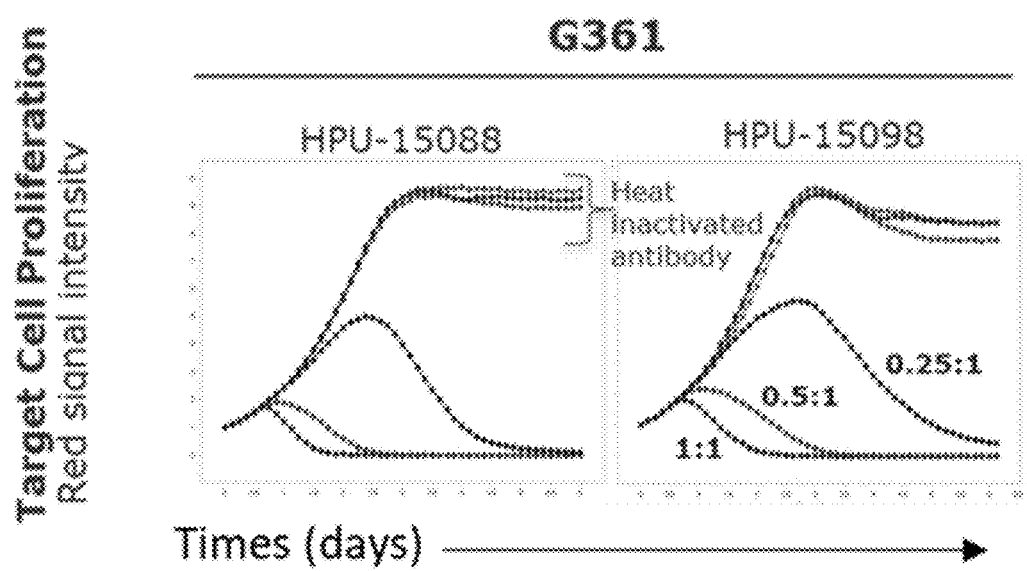
Figure 20A:
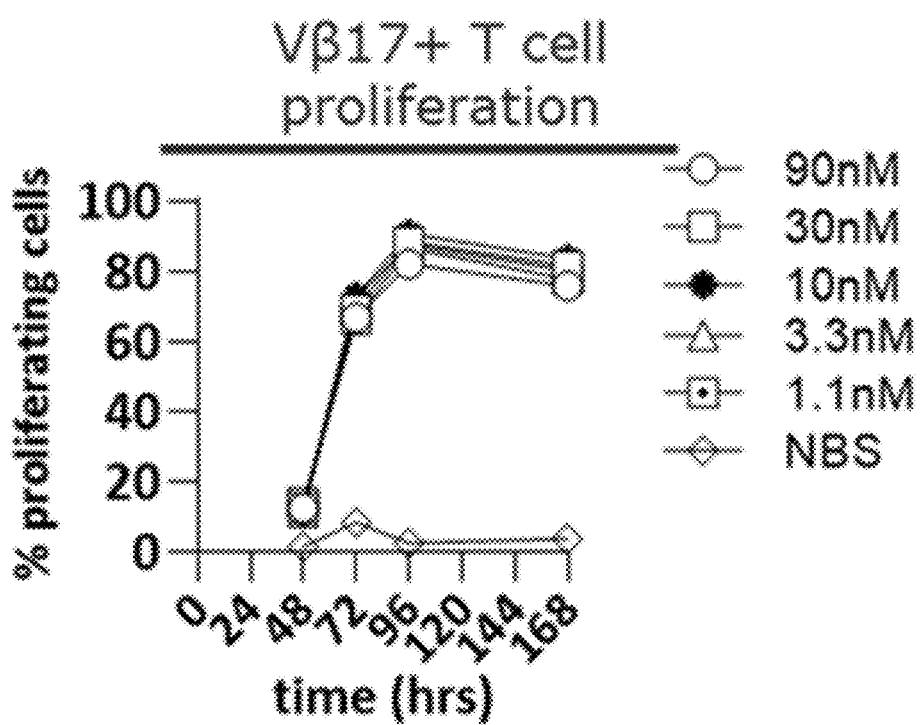
FIGS. 20A-20B show the proliferation and the frequency of Vβ17 T cells in response to different concentrations of anti-DLL3×Vβ17 antibodies.
Figure 20B:
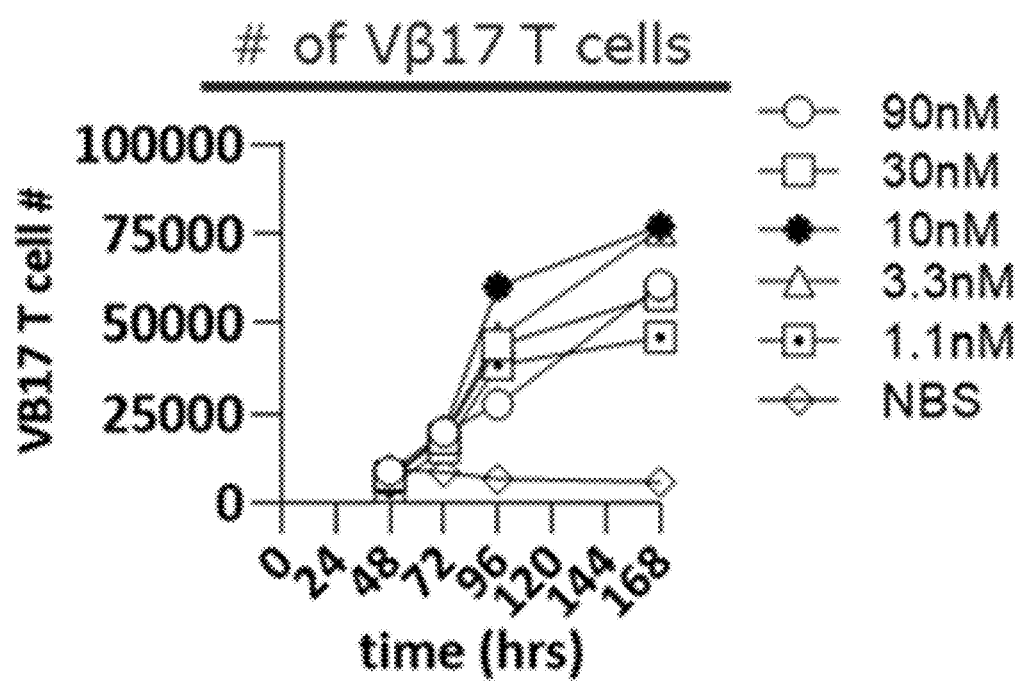
Figure 21A:
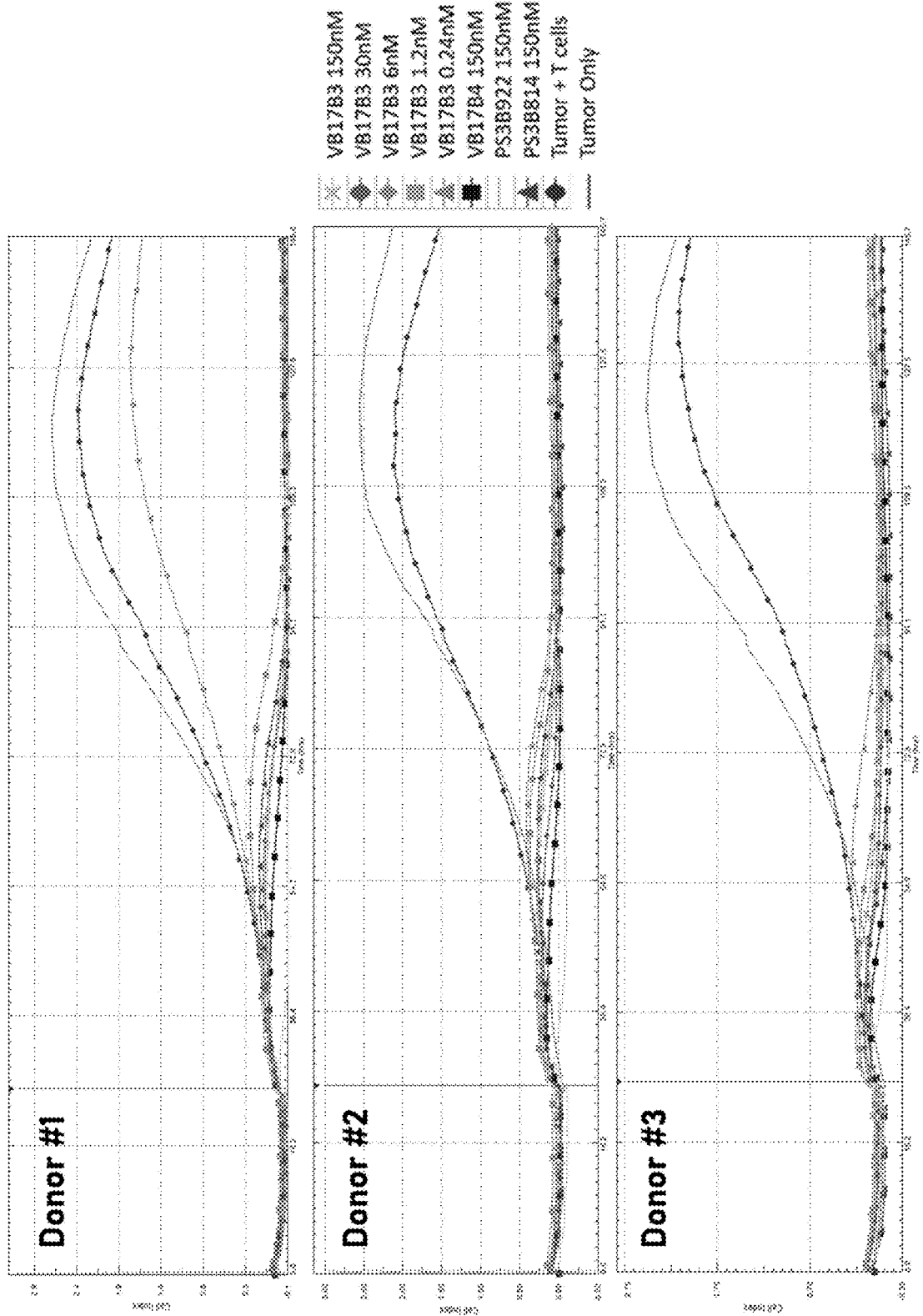
FIGS. 21A-21D show the evaluation of the cell cytolysis mediated by four different bispecific anti-PSMA×Vβ17 antibodies under E:T ratio of PAN-T:Tumor of 10:1 and different E:T ratios of Vβ17:Tumor (Donor #1: 0.5:1, Donor #2: 0.3:1, and Donor #3: 0.5:1).
Figure 21B:
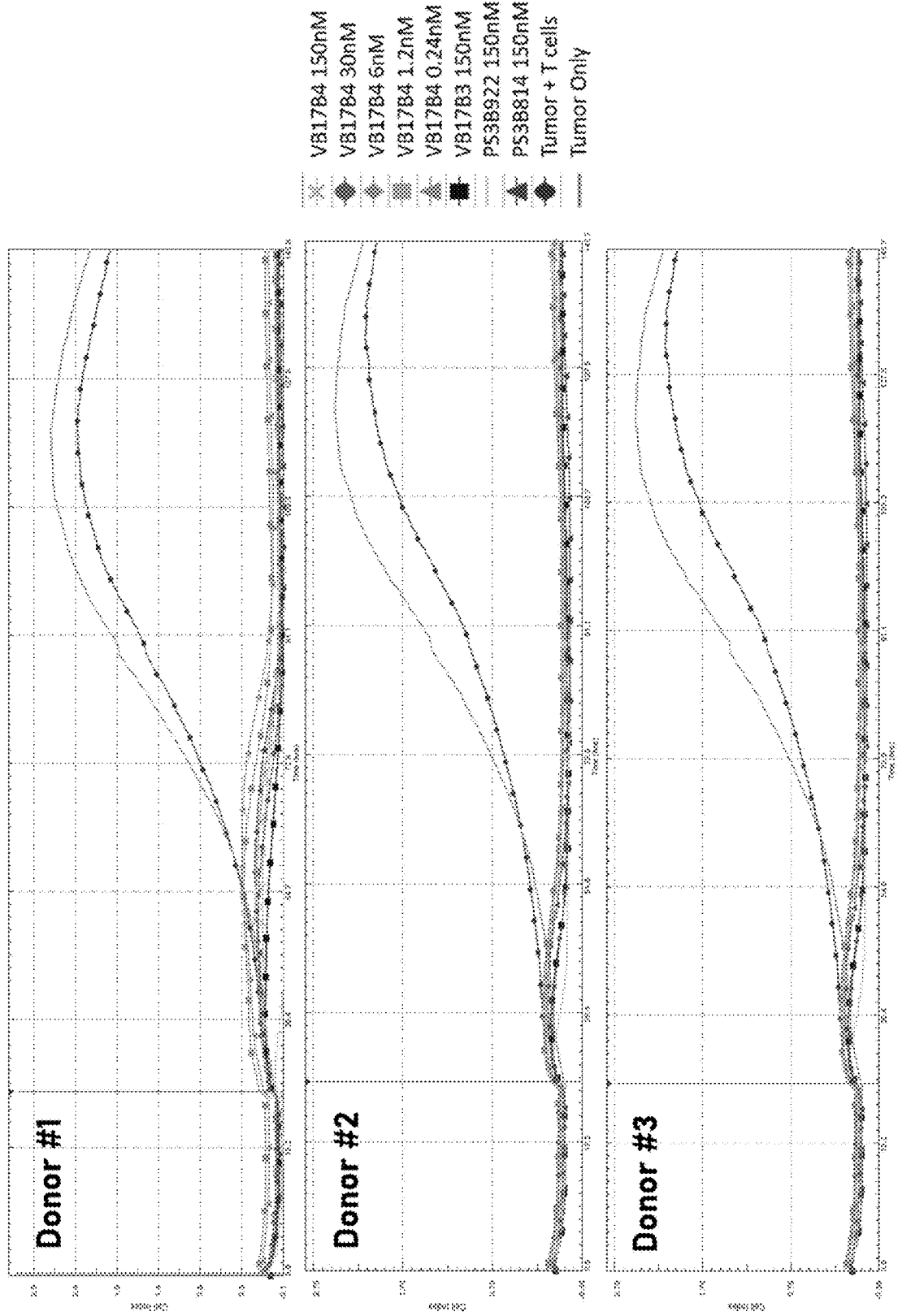
Figure 21C:
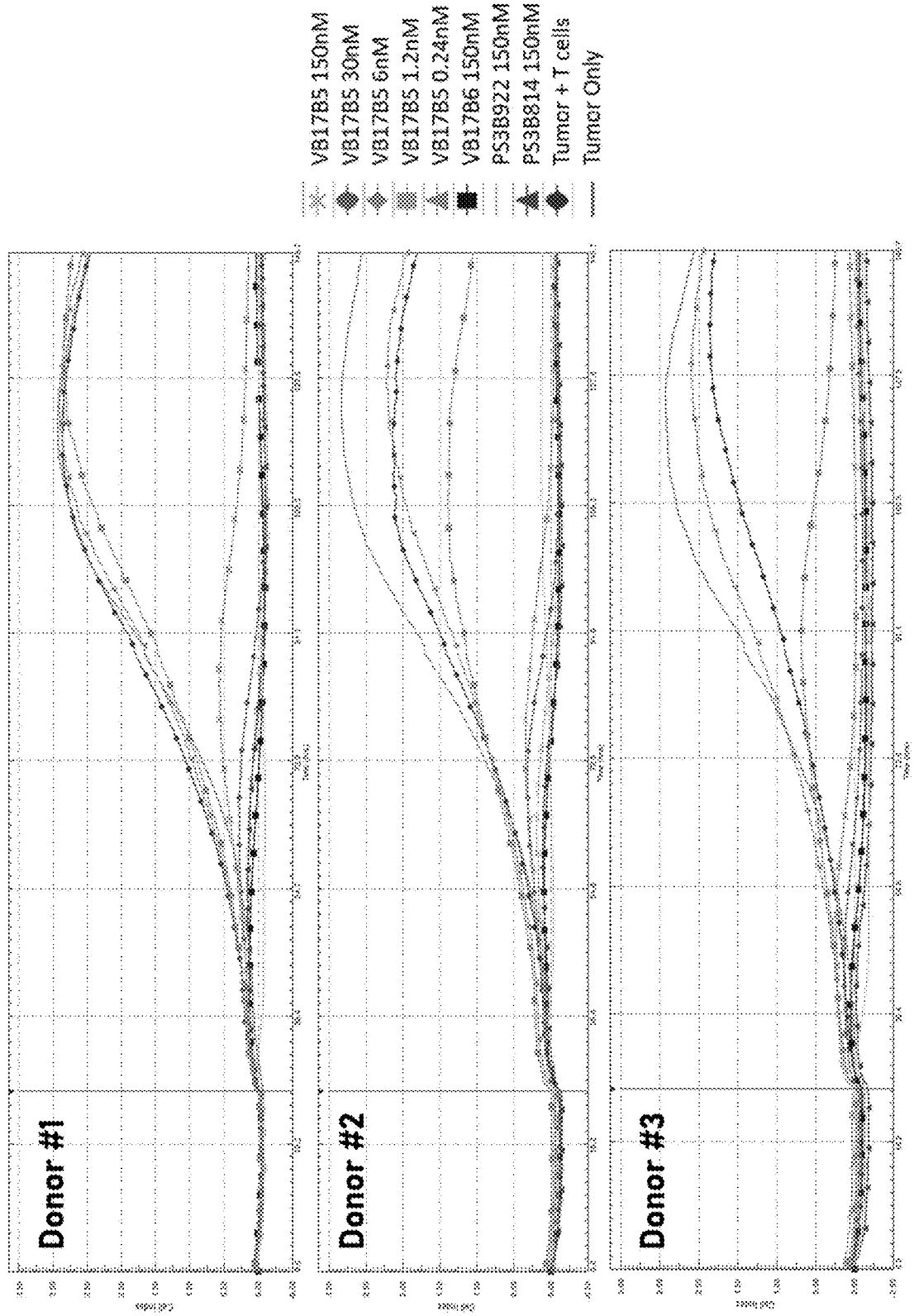
Figure 21D:
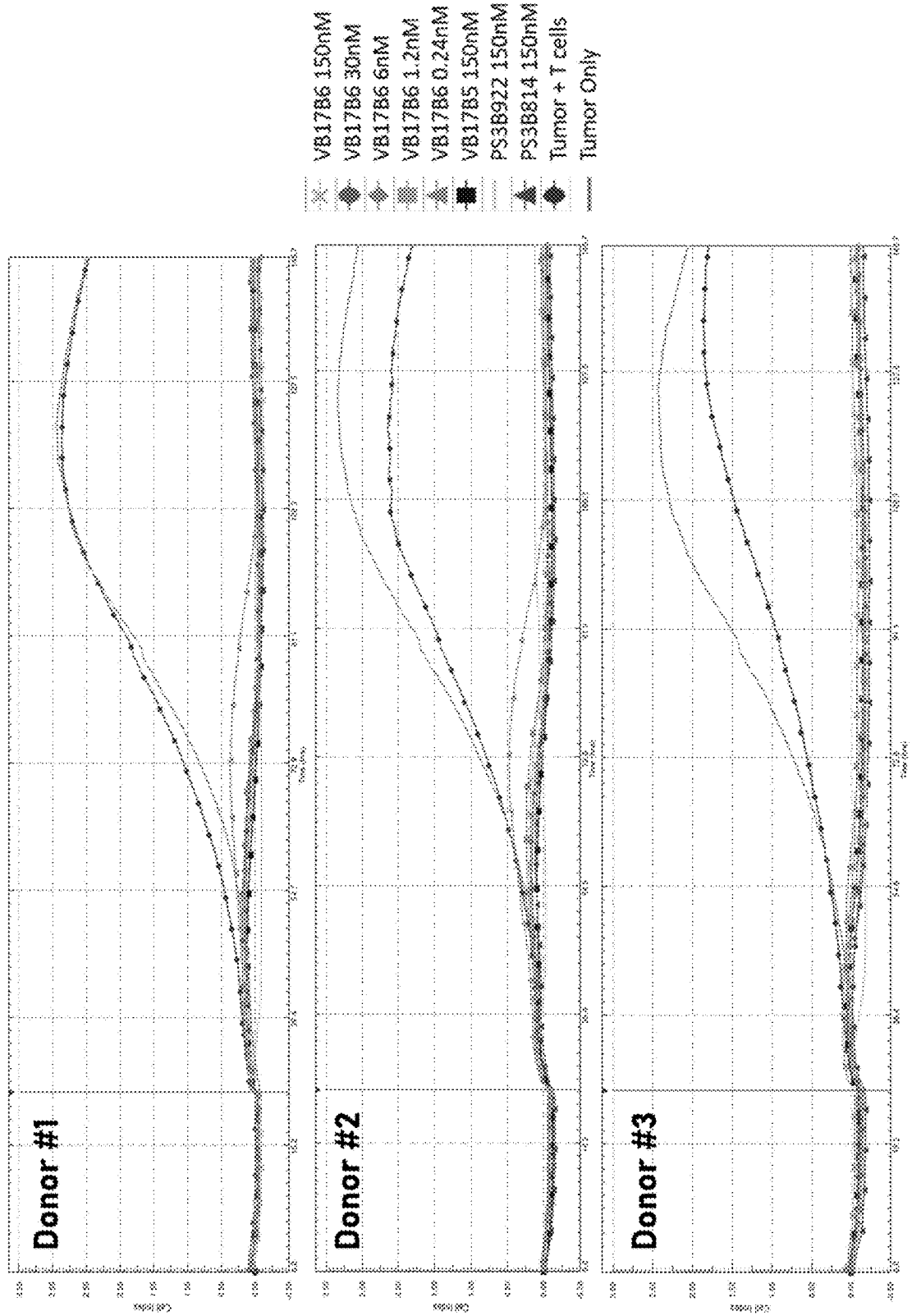

At the end of the incubation period the cells suspension was transferred to a v-Bottom plate and was spun down at 1500 rpm for 5 min. The pellet was resuspended in 100 μl of DPBS. 10 μl of the cell suspension was taken for determining the total cell count at each antibody concentration using Trypan blue with a hemocytometer. The rest of the cell suspension was subjected to LIVE/DEAD™ Fixable Near-IR Dead Cell Stain Kit (L10119) and incubated for 20 min on ice. The viability stain was inactivated using FACS buffer and was spun down at 1500 rpm for 5 min. Cells were stained with BD Fc block (564220, BD Pharmingen) for 10 min followed by staining with Vβ17-PE antibody and αβ BV510 antibody (306734, Biolegend). As shown in FIGS. 19A and 19B, bispecific anti-DLL3×Vβ17 antibody showed robust proliferation and expansion of the Vβ17 T cells. ~90% of the Vβ17 T cells underwent proliferation as indicated by the % of proliferating cells and the absolute number of Vβ17 T cells increased about 30-fold from the starting cell numbers showing a massive expansion of the Vβ17 T cell population.

Example 6—Bispecific Antibodies that Bind Vβ17 and PSMA

Example 6.1: Generation of Anti-PSMA Antibodies and scFv

Antibody generation using transgenic mice (Ablexis®). Ablexis® kappa, lambda, and kappa/lambda hybrid mice were immunized with recombinant human PSMA antigen (PSMW39.002) and cynomolgus PSMA antigen (PSMW1.009) in combination with CL413 adjuvant (InvivoGen, VAC-C413-5).

Ablexis® mice generate antibodies having human variable domains linked to human CH1 and CL domains, chimeric human/mouse hinge region, and mouse Fc regions. Ablexis® Kappa Mouse and Lambda Mouse strains are distinguished by which of their heavy chains are human or mouse as noted below. Antibodies produced by the Kappa Mouse lack sequence derived from mouse VH, DH and JH exons and mouse Vκ, Jκ and Cκ exons. The endogenous mouse Igλ is active in the Kappa Mouse. The human Igκ chains comprise approximately 90-95% of the naïve repertoire and mouse Igλ chains comprise approximately 5-10% of the naïve repertoire in this strain. Antibodies produced by the Lambda Mouse lack sequence derived from mouse VH, DH and JH exons and mouse Vλ, Jλ and Cλ exons. The endogenous mouse Igκ is active in the Lambda Mouse. The human Igλ chains comprise approximately 40% of the naïve repertoire and mouse Igκ chains comprise approximately 60% of the naïve repertoire. The preparation and use of Ablexis®, and the genomic modifications carried by such mice, is described in WO11/123708.

Mice were boosted at Days 0, 7, 14, 21, and 28 before being bled on Day 35 for serological analysis. Serology was performed on human PSMA (+) cells C4-2B (AG000002300) and a human PSMA knockout cell line (AG000002521). In total, 8 mice were selected for hybridoma fusion and final boosted on Day 56 with PSMW39.002 or an equimolar mixture of PSMW39.002 and PSMW1.009. This preparation also included recombinant anti-mouse CD40 mAb (R&D Systems, MAB440) to stimulate B cell expansion. On Day 60, spleen and draining lymph nodes were harvested from these mice, pooled and homogenized into a single cell suspension. Stable hybridomas were generated by PEG-mediated fusion of mouse myeloma cell line FO with the pooled mouse homogenate, followed by HAT selection.

Supernatants from these hybridomas were screened against C4-2B cells by MSD. From this primary screen, 440 positive samples were identified and re-arrayed for confirmatory screening. Confirmatory screening was performed by ELISA as well as Fluorescence-activated cell sorting (FACS) to validate binding to PSMA protein and PSMA (+) C4-2B cells, respectively. To ensure specificity, samples were also screened against an irrelevant negative control sample TfRW2. Based on the screening results, 214 samples were advanced past confirmatory screening from the 440 samples identified and isotyped for kappa or lambda light chain expression.

V Region Cloning. RNA from hybridoma were purified using RNEASY Plus Mini Kit (Qiagen) and used for cDNA synthesis using the Smarter cDNA synthesis kit (Clontech, Mount View, CA). To facilitate cDNA synthesis, oligodT was used to prime reverse transcription of all messenger RNAs followed by "5' capping" with a Smarter IIA oligonucleotide. Subsequent amplification of the VH and VL fragments was performed using a 2-step PCR amplification using 5' primers targeting the Smarter IIA cap and 3' primers targeting consensus regions in CH1. Briefly, each 50 µl PCR reaction consists of 20 µM of forward and reverse primer mixes, 25 µl of PRIMESTAR Max DNA polymerase premix (Clontech), 2 µl of unpurified cDNA, and 21 µl of double-distilled H2O. The cycling program starts at 94° C. for 3 min, followed by 35 cycles (94° C. for 30 Sec, 55° C. for 1 min, 68° C. for 1 min), and ends at 72° C. for 7 min. The second round PCR was performed with VL and VH 2nd round primers containing 15 bp complementary extensions that "overlap" respective regions in their respective Lonza mother vector (VH and VL). Second round PCR was performed with the following program: 94° C. for 3 min; 35 cycles (94° C. for 30 Sec, 55° C. for 1 min, 68° C. for 1 min), and ends at 72° C. for 7 min. In-Fusion® HD Cloning Kit (Clonetech, U.S.A.) was used for directional cloning of VL gene into Lonza huIgK or Lambda vector and VH gene into Lonza huIgG1 vector. To facilitate In-Fusion® HD Cloning, PCR products were treated with Cloning Enhancer before In-Fusion HD Cloning. The resulting PCR fragments were sequenced. The amino-acid sequences of the recovered-regions were codon optimized and cloned into an expression vector carrying the IgG1 constant region with L234A, L235A and D265S mutations for Fc silencing (IgG1 AAS isotype), and the K409R mutation for heterodimerization or an expression vector carrying the IgG4 constant region with S228P, F234A and L235A mutations (IgG4PAA isotype). D365E mutation was also introduced. Cloning and transformation were performed according to manufacturer's protocol (Clonetech, U.S.A.). Mini-prep DNAs were subjected to Sanger sequencing to confirm that complete V-gene fragments were obtained.

scFv and scFv-Fc formatting. Following cloning of the variable regions, the VH and VL sequences were used to generate antibodies. Antibodies were expressed in a Fab format, a mAb format, a scFv format in the VH-linker-VL orientation or a scFv format in VL-linker-VH orientation and were further analyzed as described below. The linker sequence (GGSEGKSSGSGSESKSTGGS) of SEQ ID NO:690 was used to conjugate the VH/VL regions.

The wild-type IgG1 Fc domain with the sequence described below was fused to the anti-PSMA scFv to create the scFv-Fc molecules:

```
>SEQ ID NO: 691
EPKSCDKTHTCPPCPAPELLGGPSVFLFPPKPKDTLMISRTPEVTCVVVD

VSHEDPEVKFNWYVDGVEVHNAKTKPREEQYNSTYRVVSVLTVLHQDWLN

GKEYKCKVSNKALPAPIEKTISKAKGQPREPQVYTLPPSREEMTKNQVSL

TCLVKGFYPSDIAVEWESNGQPENNYKTTPPVLDSDGSFFLYSKLTVDKS

RWQQGNVFSCSVMHEALHNHYTQKSLSLSPG
```

ExpiCHO-S™ Transfection and Purification of anti-PSMA antibodies.

Protein Expression & Cell Culture: The anti-PSMA scFv-Fc fusion proteins were expressed in ExpiCHO-S™ cells (ThermoFisher Scientific) by transient transfection with purified plasmid DNA encoding the proteins following the manufacturer's recommendations. Briefly, ExpiCHO-S™ cells were maintained in suspension in ExpiCHO™ expression medium (ThermoFisher Scientific) in an orbital shaking incubator set at 37° C., 8% $CO_2$ and 125 RPM. The cells were passaged and diluted prior to transfection to $6.0 \times 10^6$ cells per ml, maintaining cell viability at 99.0% or better. Transient transfections were done using the Expi-Fectamine™ CHO transfection kit (ThermoFisher Scientific, Cat #A29131). For each ml of diluted cells to be transfected, 0.5 microgram of scFv-Fc fusion encoding DNA and 0.5 microgram of pAdVAntage DNA (Promega, Cat #E1711) was used and diluted into OptiPRO™ SFM complexation medium. ExpiFectamine™ CHO reagent was used at a 1:4 ratio (v/v, DNA:reagent) and diluted into OptiPRO™. The diluted DNA and transfection reagent were combined for one minute, allowing DNA/lipid complex formation, and then added to the cells. After overnight incubation, ExpiCHO™ feed and ExpiFectamine™ CHO enhancers were added to the cells as per the manufacturer's Standard protocol. Cells were incubated with orbital shaking (125 rpm) at 37° C. for seven days prior to harvesting the culture broth. The culture supernatant from the transiently transfected ExpiCHO-S™ cells was clarified by centrifugation (30 min, 3000rcf) followed by filtration (0.2 µm PES membrane, Corning; Corning, NY).

Protein Purification: Antibodies were purified from the clarified supernatants using MABSELECT SURE Protein A columns equilibrated with 1×D-PBS, pH 7.2 prior. Unbound proteins were removed by washing extensively with 1×D-PBS, pH 7.2. Bound protein was eluted with 0.1 M Na-acetate, pH 3.5. Peak fractions were neutralized with 2.5 M Tris pH 7.2 and pooled. The neutralized fraction pools were utilized for bispecific DuoBody assembly. The protein concentration for each elution pool was determined by measuring absorbance at OD280 nm and calculated using absorbance extinction coefficient based on the amino acid sequence.

Example 6.2: Structural Characterization of Anti-PSMA Antibodies

Variable domains VII, VL and CDRs. Table 34 shows the VH and VL amino acid sequences of the selected anti-PSMA scFvs. Table 35 shows the Kabat CDR amino acid sequences of the selected anti-PSMA scFvs. Table 36 shows the Chothia CDR amino acid sequences of the selected anti-PSMA scFvs. Table 37 shows the AbM CDR amino acid sequences of the selected anti-PSMA scFvs. Table 37 shows the AbM CDR amino acid sequences of the selected anti-PSMA scFvs. Table 38 shows the Contact CDR amino acid sequences of the selected anti-PSMA scFvs. Table 39 shows the IMGT CDR amino acid sequences of the selected anti-PSMA scFvs. Table 40 shows the protein and DNA SEQ ID NOs for the VH and VL regions. Table 41 shows the amino acid sequences of selected anti-PSMA scFvs antibodies in VL-linker-VH (LH) format.

TABLE 34

VH and VL amino acid sequences of the selected anti-PSMA (scFv) antibodies.

| mAb name | VH name | VH amino acid Sequence | VH SEQ ID NO: | VL name | VL amino acid sequence | VL SEQ ID NO: |
|---|---|---|---|---|---|---|
| PSMB895 | PSMB895_VH | EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDGVGATPYYFDYWGQGTLVTVSS | 730 | PSMB895_VL | QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVL | 731 |
| PSMB896 | PSMB896_VH | EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDGVGATPYYFDYWGQGTLVTVSS | 732 | PSMB896_VL | QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVL | 733 |
| PSMB897 | PSMB897_VH | EVQLVESGGGLVQPGGSLRLSCAASGFTFSSYAMSWVRQAPGKGLEWVSAISGGSGSTYYADSVKGRFTISRDNSKNTLYLQMNSLRAEDSAVYYCAKDGVGATPYYFDYWGQGTLVTVSS | 734 | PSMB897_VL | QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVL | 735 |
| PSMB898 | PSMB898_VH | EVQLVESGGGLVQPGGSLRLSCAASGFTFSSYAMSWVRQAPGKGLEWVSAISGGSGSTYYADSVKGRFTISRDNSKNTLYLQMNSLRAEDSAVYYCAKDGVGATPYYFDYWGQGTLVTVSS | 736 | PSMB898_VL | QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVL | 737 |
| PSMB410 | PSMB410_VH | QLQLQESGPGLVKPSETLSLTCTVSGASISSPSYYWGWIRQPPGKGLEWIGSIFYSGSSYYNPSLKSRVIMSVDTSKNQFSLKLSSVTAADTALYYCASQSGVSGWYGAEYFQHWGQGTLVTVSS | 899 | PSMB410_Vl | DIQMTQSPSTLSASVGDRVTITCRASQSISSWLAWYQQKPGKAPKLLIYKASSLESGVPSRFGSGSGTEFTLTISSLQPDDFATYYCQQYNSYSRTFGQGTKVEIK | 900 |

TABLE 35

Kabat CDR amino acid sequences of the selected anti-PSMA (scFv) antibodies.

| mAb name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|
| PSMB895 | SYAMS | AISGGIGSTYYADSVKG | DGVGATPYYFDY | SGSSSNIGNNYVS | DNNKRPS | GTWDSSLSAYV |
|  | SEQ ID NO: 738 | SEQ ID NO: 739 | SEQ ID NO: 740 | SEQ ID NO: 741 | SEQ ID NO: 742 | SEQ ID NO: 743 |

TABLE 35-continued

Kabat CDR amino acid sequences of the selected anti-PSMA (scFv) antibodies.

| mAb name | HC Kabat CDR1 | HC Kabat CDR2 | HC Kabat CDR3 | LC Kabat CDR1 | LC Kabat CDR2 | LC Kabat CDR3 |
|---|---|---|---|---|---|---|
| PSMB896 | SYAMS | AISGGIGST YYADSVKG | DGVGATPYY FDY | SGSSSNIGI NYVS | DNNKRPS | GTWDSSLSA VV |
|  | SEQ ID NO: 744 | SEQ ID NO: 745 | SEQ ID NO: 746 | SEQ ID NO: 747 | SEQ ID NO: 748 | SEQ ID NO: 749 |
| PSMB897 | SYAMS | AISGGSGST YYADSVKG | DGVGATPYY FDY | SGSSSNIGN NYVS | DNNKRPS | GTWDSSLSA YV |
|  | SEQ ID NO: 750 | SEQ ID NO: 751 | SEQ ID NO: 752 | SEQ ID NO: 753 | SEQ ID NO: 754 | SEQ ID NO: 755 |
| PSMB898 | SYAMS | AISGGSGST YYADSVKG | DGVGATPYY FDY | SGSSSNIGI NYVS | DNNKRPS | GTWDSSLSA VV |
|  | SEQ ID NO: 756 | SEQ ID NO: 757 | SEQ ID NO: 758 | SEQ ID NO: 759 | SEQ ID NO: 760 | SEQ ID NO: 761 |
| PSMB410 | SPSYYWG | SIFYSGSSY YNPSLKS | QSGVSGWYG AEYFQH | RASQSISSW LA | KASSLES | QQYNSYSRT |
|  | SEQ ID NO: 901 | SEQ ID NO: 902 | SEQ ID NO: 903 | SEQ ID NO: 904 | SEQ ID NO: 905 | SEQ ID NO: 906 |

TABLE 36

Chothia CDR amino acid sequences of the selected anti-PSMA (scFv) antibodies.

| mAb name | HC Chothia CDR1 | HC Chothia CDR2 | HC Chothia CDR3 | LC Chothia CDR1 | LC Chothia CDR2 | LC Chothia CDR3 |
|---|---|---|---|---|---|---|
| PSMB895 | GFTFSSY | SGGIGS | GVGATPYYF D | SSSNIGNNY | DNN | WDSSLSAY |
|  | SEQ ID NO: 762 | SEQ ID NO: 763 | SEQ ID NO: 764 | SEQ ID NO: 765 | SEQ ID NO: 766 | SEQ ID NO: 767 |
| PSMB896 | GFTFSSY | SGGIGS | GVGATPYYF D | SSSNIGINY | DNN | WDSSLSAV |
|  | SEQ ID NO: 768 | SEQ ID NO: 769 | SEQ ID NO: 770 | SEQ ID NO: 771 | SEQ ID NO: 772 | SEQ ID NO: 773 |
| PSMB897 | GFTFSSY | SGGSGS | GVGATPYYF D | SSSNIGNNY | DNN | WDSSLSAY |
|  | SEQ ID NO: 774 | SEQ ID NO: 775 | SEQ ID NO: 776 | SEQ ID NO: 777 | SEQ ID NO: 778 | SEQ ID NO: 779 |
| PSMB898 | GFTFSSY | SGGSGS | GVGATPYYF D | SSSNIGINY | DNN | WDSSLSAV |
|  | SEQ ID NO: 780 | SEQ ID NO: 781 | SEQ ID NO: 782 | SEQ ID NO: 783 | SEQ ID NO: 784 | SEQ ID NO: 785 |
| PSMB410 | GASISSPSY | FYSGS | QSGVSGWYG AEYFQH | RASQSISSW LA | KASSLES | QQYNSYSRT |
|  | SEQ ID NO: 907 | SEQ ID NO: 908 | SEQ ID NO: 909 | SEQ ID NO: 910 | SEQ ID NO: 911 | SEQ ID NO: 912 |

TABLE 37

AbM CDR amino acid sequences of the selected anti-PSMA (scFv) antibodies.

| mAb name | HC AbM CDR1 | HC AbM CDR2 | HC AbM CDR3 | LC AbM CDR1 | LC AbM CDR2 | LC AbM CDR3 |
|---|---|---|---|---|---|---|
| PSMB895 | GFTFSSYAM S | AISGGIGST Y | DGVGATPYY FDY | SGSSSNIGN NYVS | DNNKRPS | GTWDSSLSA YV |
|  | SEQ ID NO: 786 | SEQ ID NO: 787 | SEQ ID NO: 788 | SEQ ID NO: 789 | SEQ ID NO: 790 | SEQ ID NO: 791 |

TABLE 37-continued

AbM CDR amino acid sequences of the selected anti-PSMA (scFv) antibodies.

| mAb name | HC AbM CDR1 | HC AbM CDR2 | HC AbM CDR3 | LC AbM CDR1 | LC AbM CDR2 | LC AbM CDR3 |
|---|---|---|---|---|---|---|
| PSMB896 | GFTFSSYAMS SEQ ID NO: 792 | AISGGIGSTY SEQ ID NO: 793 | DGVGATPYYFDY SEQ ID NO: 794 | SGSSSNIGINYVS SEQ ID NO: 795 | DNNKRPS SEQ ID NO: 796 | GTWDSSLSAVV SEQ ID NO: 797 |
| PSMB897 | GFTFSSYAMS SEQ ID NO: 798 | AISGGSGSTY SEQ ID NO: 799 | DGVGATPYYFDY SEQ ID NO: 800 | SGSSSNIGNNYVS SEQ ID NO: 801 | DNNKRPS SEQ ID NO: 802 | GTWDSSLSAYV SEQ ID NO: 803 |
| PSMB898 | GFTFSSYAMS SEQ ID NO: 804 | AISGGSGSTY SEQ ID NO: 805 | DGVGATPYYFDY SEQ ID NO: 806 | SGSSSNIGINYVS SEQ ID NO: 807 | DNNKRPS SEQ ID NO: 808 | GTWDSSLSAVV SEQ ID NO: 809 |
| PSMB410 | GASISSPSYYWG SEQ ID NO: 913 | SIFYSGSSY SEQ ID NO: 914 | QSGVSGWYGAEYFQH SEQ ID NO: 915 | RASQSISSWLA SEQ ID NO: 916 | KASSLES SEQ ID NO: 917 | QQYNSYSRT SEQ ID NO: 918 |

TABLE 38

Contact CDR amino acid sequences of the selected anti-PSMA (scFv) antibodies.

| mAb name | HC Contact CDR1 | HC Contact CDR2 | HC Contact CDR3 | LC Contact CDR1 | LC Contact CDR2 | LC Contact CDR3 |
|---|---|---|---|---|---|---|
| PSMB895 | SSYAMS SEQ ID NO: 810 | WVSAISGGIGSTY SEQ ID NO: 811 | AKDGVGATPYYFD SEQ ID NO: 812 | IGNNYVSWY SEQ ID NO: 813 | LLIYDNNKRP SEQ ID NO: 814 | GTWDSSLSAY SEQ ID NO: 815 |
| PSMB896 | SSYAMS SEQ ID NO: 816 | WVSAISGGIGSTY SEQ ID NO: 817 | AKDGVGATPYYFD SEQ ID NO: 818 | IGINYVSWY SEQ ID NO: 819 | LLIYDNNKRP SEQ ID NO: 820 | GTWDSSLSAV SEQ ID NO: 821 |
| PSMB897 | SSYAMS SEQ ID NO: 822 | WVSAISGGSGSTY SEQ ID NO: 823 | AKDGVGATPYYFD SEQ ID NO: 824 | IGNNYVSWY SEQ ID NO: 825 | LLIYDNNKRP SEQ ID NO: 826 | GTWDSSLSAY SEQ ID NO: 827 |
| PSMB898 | SSYAMS SEQ ID NO: 828 | WVSAISGGSGSTY SEQ ID NO: 829 | AKDGVGATPYYFD SEQ ID NO: 830 | IGINYVSWY SEQ ID NO: 831 | LLIYDNNKRP SEQ ID NO: 832 | GTWDSSLSAV SEQ ID NO: 833 |
| PSMB410 | SSPSYYWG SEQ ID NO: 919 | WIGSIFYSGSSY SEQ ID NO: 920 | ASQSGVSGWYGAEYFQ SEQ ID NO: 921 | SSWLAWY SEQ ID NO: 922 | LLIYKASSLE SEQ ID NO: 923 | QQYNSYSR SEQ ID NO: 924 |

TABLE 39

IMGT CDR amino acid sequences of the selected anti-PSMA (scFv) antibodies.

| mAb name | HC Contact CDR1 | HC Contact CDR2 | HC Contact CDR3 | LC Contact CDR1 | LC Contact CDR2 | LC Contact CDR3 |
|---|---|---|---|---|---|---|
| PSMB895 | GFTFSSYA SEQ ID NO: 834 | ISGGIGST SEQ ID NO: 835 | AKDGVGATPYYFDY SEQ ID NO: 836 | SSNIGNNY SEQ ID NO: 837 | DNN SEQ ID NO: 838 | GTWDSSLSAYV SEQ ID NO: 839 |

TABLE 39-continued

IMGT CDR amino acid sequences of the selected anti-PSMA (scFv) antibodies.

| mAb name | HC Contact CDR1 | HC Contact CDR2 | HC Contact CDR3 | LC Contact CDR1 | LC Contact CDR2 | LC Contact CDR3 |
|---|---|---|---|---|---|---|
| PSMB896 | GFTFSSYA | ISGGIGST | AKDGVGATPYYFDY | SSNIGINY | DNN | GTWDSSLSAVV |
|  | SEQ ID NO: 840 | SEQ ID NO: 841 | SEQ ID NO: 842 | SEQ ID NO: 843 | SEQ ID NO: 844 | SEQ ID NO: 845 |
| PSMB897 | GFTFSSYA | ISGGSGST | AKDGVGATPYYFDY | SSNIGNNY | DNN | GTWDSSLSAYV |
|  | SEQ ID NO: 846 | SEQ ID NO: 847 | SEQ ID NO: 848 | SEQ ID NO: 849 | SEQ ID NO: 850 | SEQ ID NO: 851 |
| PSMB898 | GFTFSSYA | ISGGSGST | AKDGVGATPYYFDY | SSNIGINY | DNN | GTWDSSLSAVV |
|  | SEQ ID NO: 852 | SEQ ID NO: 853 | SEQ ID NO: 854 | SEQ ID NO: 855 | SEQ ID NO: 856 | SEQ ID NO: 857 |
| PSMB410 | GASISSPSYY | IFYSGSS | ASQSGVSGWYGAEYFQH | QSISSW | KAS | QQYNSYSRT |
|  | SEQ ID NO: 925 | SEQ ID NO: 926 | SEQ ID NO: 927 | SEQ ID NO: 928 | SEQ ID NO: 929 | SEQ ID NO: 930 |

TABLE 40

SEQ ID NOs of Protein and DNA sequences of the VH and VL domains of selected anti-PSMA antibodies.

| Antibody | VH Protein SEQ ID NO: | VL Protein SEQ ID NO: | VH cDNA SEQ ID NO: | VL cDNA SEQ ID NO: |
|---|---|---|---|---|
| PSMB895 | 730 | 731 | 858 | 859 |
| PSMB896 | 732 | 733 | 860 | 861 |
| PSMB897 | 734 | 735 | 862 | 863 |
| PSMB898 | 736 | 737 | 864 | 865 |
| PSMB410 | 899 | 900 | N/A | N/A |

>SEQ ID NO: 858 (PSMB895_VH cDNA)
GAGGTACAACTTGTGGAAAGTGGAGGCGGTCTTGTCCAACCTGGAGGATCTCTCCGATTGAG
TTGCGCAGCCAGCGGGTTTACTTTTTCTTCATACGCCATGTCCTGGGTGCGGCAAGCACCAG
GTAAAGGACTTGAGTGGGTATCTGCTATTTCAGGGGGGATAGGCTAACATACTATGCTGAT
AGCGTGAAAGGTAGGTTCACCATTTCCCGTGACAATAGTAAAAACACATTGTGGCTCCAAAT
GAACAGCCTTAGGGCTGAAGACACCGCTGTTTACTACTGCGCTAAAGACGGTGTAGGGGCAA
CTCCCTATTACTTCGATTATTGGGGACAAGGAACCTTGGTAACAGTTTCAAGC

>SEQ ID NO: 860 (PSMB896_VH cDNA)
GAGGTACAACTTGTGGAAAGTGGAGGCGGTCTTGTCCAACCTGGAGGATCTCTCCGATTGAG
TTGCGCAGCCAGCGGGTTTACTTTTTCTTCATACGCCATGTCCTGGGTGCGGCAAGCACCAG
GTAAAGGACTTGAGTGGGTATCTGCTATTTCAGGGGGGATAGGCTAACATACTATGCTGAT
AGCGTGAAAGGTAGGTTCACCATTTCCCGTGACAATAGTAAAAACACATTGTGGCTCCAAAT
GAACAGCCTTAGGGCTGAAGACACCGCTGTTTACTACTGCGCTAAAGACGGTGTAGGGGCAA
CTCCCTATTACTTCGATTATTGGGGACAAGGAACCTTGGTAACAGTTTCAAGC

>SEQ ID NO: 862 (PSMB897_VH cDNA)
GAAGTCCAGTTGGTAGAATCTGGAGGCGGGCTGGTACAGCCTGGCGGTTCCTTGCGCCTCTC
ATGTGCCGCAAGCGGGTTTACCTTCAGCTCTTACGCAATGTCATGGGTGCGTCAGGCCCCTG
GAAAAGGTCTCGAGTGGGTCAGTGCCATTTCTGGGGGCTCCGGCTCCACCTACTACGCAGAT
TCAGTTAAAGGGAGATTTACAATCTCAAGAGATAACAGTAAAAACACCCTCTACCTCCAGAT
GAACTCACTTCGAGCTGAGGATTCAGCAGTATATTACTGTGCTAAAGACGGTGTAGGTGCAA
CTCCCTACTATTTCGACTATTGGGGCCAAGGGACTTTGGTGACAGTAAGTAGT

>SEQ ID NO: 864 (PSMB898_VH cDNA)
GAAGTCCAGTTGGTAGAATCTGGAGGCGGGCTGGTACAGCCTGGCGGTTCCTTGCGCCTCTC
ATGTGCCGCAAGCGGGTTTACCTTCAGCTCTTACGCAATGTCATGGGTGCGTCAGGCCCCTG
GAAAAGGTCTCGAGTGGGTCAGTGCCATTTCTGGGGGCTCCGGCTCCACCTACTACGCAGAT
TCAGTTAAAGGGAGATTTACAATCTCAAGAGATAACAGTAAAAACACCCTCTACCTCCAGAT
GAACTCACTTCGAGCTGAGGATTCAGCAGTATATTACTGTGCTAAAGACGGTGTAGGTGCAA
CTCCCTACTATTTCGACTATTGGGGCCAAGGGACTTTGGTGACAGTAAGTAGT

TABLE 40-continued

SEQ ID NOs of Protein and DNA sequences of the VH and VL domains of selected anti-PSMA antibodies.

>SEQ ID NO: 859 (PSMB895_VL cDNA)
CAATCTGTCCTGACTCAACCTCCCTCAGTCTCAGCCGCACCAGGACAGAAGGTGACAATTAG
CTGTTCAGGTTCTTCAAGTAACATCGGTAACAACTACGTCTCATGGTATCAACAGCTTCCCG
GAACAGCACCCAAACTGCTGATATATGATAACAACAAACGGCCATCTGGAATACCAGACCGG
TTCTCAGGCTCCAAGAGCGGTACTAGCGCAACTTTGGGAATCACCGGTTTGCAGACTGGGGA
TGAGGCAGACTATTACTGCGGCACCTGGGATTCCAGTCTGTCTGCTTATGTTTTTGGGACCG
GGACAAAGGTGACTGTCCTT

>SEQ ID NO: 861 (PSMB896_VL cDNA)
CAGAGTGTCCTTACTCAGCCTCCTAGCGTTAGCGCCGCCCCTGGACAGAAGGTTACTATCTC
CTGCTCAGGGAGTTCCAGTAATATTGGAATCAATTATGTGAGTTGGTATCAGCAGTTGCCCG
GCACCGCTCCTAAATTGCTTATCTATGACAACAATAAACGACCTAGTGGTATCCCTGATCGT
TTTTCTGGATCAAAATCTGGTACTAGCGCAACCCTCGGTATCACCGGACTGCAAACAGGTGA
TGAAGCAGACTATTATTGCGGCACCTGGGACTCATCACTCTCCGCCGTCGTTTTCGGGGGCG
GAACCAAACTTACAGTATTG

>SEQ ID NO: 863 (PSMB897_VL cDNA)
CAATCTGTCCTGACTCAACCTCCCTCAGTCTCAGCCGCACCAGGACAGAAGGTGACAATTAG
CTGTTCAGGTTCTTCAAGTAACATCGGTAACAACTACGTCTCATGGTATCAACAGCTTCCCG
GAACAGCACCCAAACTGCTGATATATGATAACAACAAACGGCCATCTGGAATACCAGACCGG
TTCTCAGGCTCCAAGAGCGGTACTAGCGCAACTTTGGGAATCACCGGTTTGCAGACTGGGGA
TGAGGCAGACTATTACTGCGGCACCTGGGATTCCAGTCTGTCTGCTTATGTTTTTGGGACCG
GGACAAAGGTGACTGTCCTT

>SEQ ID NO: 865 (PSMB898_VL cDNA)
CAGAGTGTCCTTACTCAGCCTCCTAGCGTTAGCGCCGCCCCTGGACAGAAGGTTACTATCTC
CTGCTCAGGGAGTTCCAGTAATATTGGAATCAATTATGTGAGTTGGTATCAGCAGTTGCCCG
GCACCGCTCCTAAATTGCTTATCTATGACAACAATAAACGACCTAGTGGTATCCCTGATCGT
TTTTCTGGATCAAAATCTGGTACTAGCGCAACCCTCGGTATCACCGGACTGCAAACAGGTGA
TGAAGCAGACTATTATTGCGGCACCTGGGACTCATCACTCTCCGCCGTCGTTTTCGGGGGCG
GAACCAAACTTACAGTATTG

TABLE 41

Amino acid sequences of the selected anti-PSMA scFvs antibodies in VL-linker-VH (LH) format.

| scFv name | Amino acid sequence | SEQ ID NO: |
|---|---|---|
| PSMB895-LH-scFV | QSVLTQPPSVSAAPGQKVTISCSGSSSNIGNNYVSWYQQLPGT APKLLIYDNNKRPSGIPDRFSGSKSGTSATLGITGLQTGDEAD YYCGTWDSSLSAYVFGTGTKVTVLGGSEGKSSGSGSESKSTGG SEVQLVESGGGLVQPGGSLRLSCAASGFTFSSYAMSWVRQAPG KGLEWVSAISGGIGSTYYADSVKGRFTISRDNSKNTLWLQMNS LRAEDTAVYYCAKDGVGATPYYFDYWGQGTLVTVSSEPKSSDK THTCPPCPAPEAAGGPSVFLFPPKPKDTLMISRTPEVTCVVVS VSHEDPEVKFNWYVDGVEVHNAKTKPREEQYNSTYRVVSVLTV LHQDWLNGKEYKCKVSNKALPAPIEKTISKAKGQPREPQVYVL PPSREEMTKNQVSLLCLVKGFYPSDIAVEWESNGQPENNYLTW PPVLDSDGSFFLYSKLTVDKSRWQQGNVFSCSVMHEALHNHYT QKSLSLSPGK | 866 |
| PSMB896-LH-scFV | QSVLTQPPSVSAAPGQKVTISCSGSSSNIGINYVSWYQQLPGT APKLLIYDNNKRPSGIPDRFSGSKSGTSATLGITGLQTGDEAD YYCGTWDSSLSAVVFGGGTKLTVLGGSEGKSSGSGSESKSTGG SEVQLVESGGGLVQPGGSLRLSCAASGFTFSSYAMSWVRQAPG KGLEWVSAISGGIGSTYYADSVKGRFTISRDNSKNTLWLQMNS LRAEDTAVYYCAKDGVGATPYYFDYWGQGTLVTVSSEPKSSDK THTCPPCPAPEAAGGPSVFLFPPKPKDTLMISRTPEVTCVVVS VSHEDPEVKFNWYVDGVEVHNAKTKPREEQYNSTYRVVSVLTV LHQDWLNGKEYKCKVSNKALPAPIEKTISKAKGQPREPQVYVL PPSREEMTKNQVSLLCLVKGFYPSDIAVEWESNGQPENNYLTW PPVLDSDGSFFLYSKLTVDKSRWQQGNVFSCSVMHEALHNHYT QKSLSLSPGK | 867 |
| PSMB897-LH-scFV | QSVLTQPPSVSAAPGQKVTISCSGSSSNIGNNYVSWYQQLPGT APKLLIYDNNKRPSGIPDRFSGSKSGTSATLGITGLQTGDEAD YYCGTWDSSLSAYVFGTGTKVTVLGGSEGKSSGSGSESKSTGG SEVQLVESGGGLVQPGGSLRLSCAASGFTFSSYAMSWVRQAPG KGLEWVSAISGGSGSTYYADSVKGRFTISRDNSKNTLYLQMNS LRAEDSAVYYCAKDGVGATPYYFDYWGQGTLVTVSSEPKSSDK THTCPPCPAPEAAGGPSVFLFPPKPKDTLMISRTPEVTCVVVS VSHEDPEVKFNWYVDGVEVHNAKTKPREEQYNSTYRVVSVLTV | 868 |

TABLE 41-continued

Amino acid sequences of the selected anti-PSMA scFvs antibodies in VL-linker-VH (LH) format.

| scFv name | Amino acid sequence | SEQ ID NO: |
|---|---|---|
| | LHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK | |
| PSMB898-LH-scFV | QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVLGGSEGKSSGSGSESKSTGGSEVQLVESGGGLVQPGGSLRLSCAASGFTFSSYAMSWVRQAPGKGLEWVSAISGGSGSTYYADSVKGRFTISRDNSKNTLYLQMNSLRAEDSAVYYCAKDGVGATPYYFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK | 869 |
| PSMB410_LH-scFV | DIQMTQSPSTLSASVGDRVTITCRASQSISSWLAWYQQKPGKAPKLLIYKASSLESGVPSRFSGSGSGTEFTLTISSLQPDDFATYYCQQYNSYSRTFGQGTKVEIKGGSEGKSSGSGSESKSTGGSQLQLQESGPGLVKPSETLSLTCTVSGASISSPSYYWGWIRQPPGKGLEWIGSIFYSGSSYYNPSLKSRVIMSVDTSKNQFSLKLSSVTAADTALYYCASQSGVSGWYGAEYFQHWGQGTLVTVSSEPKSSDKTHTCPPCPAPEAAGGPSVFLFPPKPKDILMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK | 931 |

The DNA sequences of the selected anti-PSMA scFv antibodies in VL-linker-VH (LH) format are listed below.

>PSMB895-LH-scFV DNA;

SEQ ID NO: 870

CAGTCTGTGCTGACCCAGCCTCCTTCTGTGTCTGCTGCTCCTGGCCAGAA

AGTGACCATCTCCTGCTCCGGCTCCTCCTCCAACATCGGCAACAACTACG

TGTCCTGGTATCAGCAGCTGCCCGGCACAGCTCCCAAACTGCTGATCTAC

GACAACAACAAGCGGCCCAGCGGCATCCCTGACAGATTCTCCGGATCTAA

GTCCGGCACCTCTGCTACCCTGGGCATCACAGGATTGCAGACAGGCGACG

AGGCCGACTACTATTGCGGCACCTGGGACTCTTCCCTGTCCGCTTATGTG

TTTGGCACCGGCACCAAAGTGACCGTGTTGGGCGGCTCCGAGGGCAAGAG

CAGCGGCAGCGGCAGCGAGAGCAAGAGCACCGGCGGCAGCGAGGTGCAGC

TGGTTGAATCTGGCGGAGGATTGGTTCAGCCTGGCGGTTCTCTGAGACTG

TCTTGTGCCGCTTCCGGCTTCACCTTCTCCAGCTACGCTATGTCCTGGGT

CCGACAGGCTCCTGGCAAAGGACTGGAATGGGTGTCCGCTATCTCTGGCG

GCATCGGCTCTACCTACTACGCCGACTCTGTGAAGGGCAGATTCACCATC

AGCCGGGACAACTCCAAGAACACCCTGTGGCTGCAGATGAACTCCCTGAG

AGCCGAGGATACCGCCGTGTACTACTGTGCCAAAGATGGCGTGGGCGCTA

CCCCTTACTACTTCGATTATTGGGGCCAGGGCACCCTGGTCACCGTTTCT

TCTGAGCCCAAATCTAGCGACAAAACTCACACTTGTCCACCGTGCCCAGC

ACCTGAAGCAGCAGGGGGACCGTCAGTCTTCCTCTTCCCCCCAAAACCCA

AGGACACCCTCATGATCTCCCGGACCCCTGAGGTCACATGCGTGGTGGTG

AGCGTGAGCCACGAAGACCCTGAGGTCAAGTTCAACTGGTACGTGGACGG

CGTGGAGGTGCATAATGCCAAGACAAAGCCGCGGGAGGAGCAGTACAACA

GCACGTACCGTGTGGTCAGCGTCCTCACCGTCCTGCACCAGGACTGGCTG

AATGGCAAGGAGTACAAGTGCAAGGTGTCCAACAAAGCCCTCCCAGCCCC

CATCGAGAAAACCATCTCCAAAGCCAAAGGGCAGCCCCGAGAACCACAGG

TGTACGTGCTGCCCCCATCCCGGGAGGAGATGACCAAGAACCAGGTCAGC

CTGCTGTGCCTGGTCAAAGGCTTCTATCCCAGCGACATCGCCGTGGAGTG

GGAGAGCAATGGGCAGCCGGAGAACAACTACCTCACCTGGCCTCCCGTGC

TGGACTCCGACGGCTCCTTCTTCCTCTACAGCAAGCTCACCGTGGACAAG

TCCAGATGGCAGCAGGGGAACGTCTTCTCATGCTCCGTGATGCATGAGGC

TCTGCACAACCACTACACGCAGAAGTCTCTCTCCCTGTCTCCGGGAAAA

>P5MB896-LH-scFV DNA;

SEQ ID NO: 871

CAGTCTGTGCTGACCCAGCCTCCTTCTGTGTCTGCTGCTCCTGGCCAGAA

AGTGACCATCTCCTGCTCCGGCTCCTCCTCCAACATCGGCATCAACTACG

TGTCCTGGTATCAGCAGCTGCCCGGCACAGCTCCCAAACTGCTGATCTAC

GACAACAACAAGCGGCCCAGCGGCATCCCTGACAGATTCTCCGGATCTAA

GTCCGGCACCTCTGCTACCCTGGGCATCACAGGATTGCAGACAGGCGACG

AGGCCGACTACTATTGCGGCACCTGGGACTCTTCTCTGTCCGCCGTTGTT

TTTGGCGGTGGCACCAAGCTGACAGTGCTCGGCGGCTCCGAGGGCAAGAG

CAGCGGCAGCGGCAGCGAGAGCAAGAGCACCGGCGGCAGCGAGGTGCAGC

TGGTTGAATCTGGCGGAGGATTGGTTCAGCCTGGCGGTTCTCTGAGACTG

TCTTGTGCCGCTTCCGGCTTCACCTTCTCCAGCTACGCTATGTCCTGGGT

CCGACAGGCTCCTGGCAAAGGACTGGAATGGGTGTCCGCTATCTCTGGCG

GCATCGGCTCTACCTACTACGCCGACTCTGTGAAGGGCAGATTCACCATC

AGCCGGGACAACTCCAAGAACACCCTGTGGCTGCAGATGAACTCCCTGAG

AGCCGAGGATACCGCCGTGTACTACTGTGCCAAAGATGGCGTGGGCGCTA

CCCCTTACTACTTCGATTATTGGGGCCAGGGCACCCTGGTCACCGTTTCT

TCTGAGCCCAAATCTAGCGACAAAACTCACACTTGTCCACCGTGCCCAGC

ACCTGAAGCAGCAGGGGGACCGTCAGTCTTCCTCTTCCCCCCAAAACCCA

AGGACACCCTCATGATCTCCCGGACCCCTGAGGTCACATGCGTGGTGGTG

AGCGTGAGCCACGAAGACCCTGAGGTCAAGTTCAACTGGTACGTGGACGG

CGTGGAGGTGCATAATGCCAAGACAAAGCCGCGGGAGGAGCAGTACAACA

GCACGTACCGTGTGGTCAGCGTCCTCACCGTCCTGCACCAGGACTGGCTG

AATGGCAAGGAGTACAAGTGCAAGGTGTCCAACAAAGCCCTCCCAGCCCC

CATCGAGAAAACCATCTCCAAAGCCAAAGGGCAGCCCCGAGAACCACAGG

TGTACGTGCTGCCCCCATCCCGGGAGGAGATGACCAAGAACCAGGTCAGC

CTGCTGTGCCTGGTCAAAGGCTTCTATCCCAGCGACATCGCCGTGGAGTG

GGAGAGCAATGGGCAGCCGGAGAACAACTACCTCACCTGGCCTCCCGTGC

TGGACTCCGACGGCTCCTTCTTCCTCTACAGCAAGCTCACCGTGGACAAG

TCCAGATGGCAGCAGGGGAACGTCTTCTCATGCTCCGTGATGCATGAGGC

TCTGCACAACCACTACACGCAGAAGTCTCTCTCCCTGTCTCCGGGAAAA

>PSMB897-LH-scFV DNA;

SEQ ID NO: 872

CAGTCTGTGCTGACCCAGCCTCCTTCTGTGTCTGCTGCTCCTGGCCAGAA

AGTGACCATCTCCTGCTCCGGCTCCTCCTCCAACATCGGCAACAACTACG

TGTCCTGGTATCAGCAGCTGCCCGGCACAGCTCCCAAACTGCTGATCTAC

GACAACAACAAGCGGCCCAGCGGCATCCCTGACAGATTCTCCGGATCTAA

GTCCGGCACCTCTGCTACCCTGGGCATCACAGGATTGCAGACAGGCGACG

AGGCCGACTACTATTGCGGCACCTGGGACTCTTTCCCTGTCCGCTTATGTG

TTTGGCACCGGCACCAAAGTGACCGTGTTGGGCGGCTCCGAGGGCAAGAG

CAGCGGCAGCGGCAGCGAGAGCAAGAGCACCGGCGGCAGCGAGGTGCAGC

TGGTTGAATCTGGCGGAGGATTGGTTCAGCCTGGCGGTTCTCTGAGACTG

TCTTGTGCCGCTTCCGGCTTCACCTTCTCCAGCTACGCTATGTCCTGGGT

CCGACAGGCTCCTGGCAAAGGACTGGAATGGGTGTCCGCTATCTCTGGCG

GATCCGGCTCTACCTACTACGCCGACTCTGTGAAGGGCAGATTCACCATC

AGCCGGGACAACTCCAAGAACACCCTGTACCTGCAGATGAACTCCCTGAG

AGCCGAGGACTCCGCCGTGTACTACTGTGCTAAAGATGGCGTGGGCGCTA

CCCCTTACTACTTCGATTATTGGGGCCAGGGCACCCTGGTCACCGTTTCT

TCTGAGCCCAAATCTAGCGACAAAACTCACACTTGTCCACCGTGCCCAGC

ACCTGAAGCAGCAGGGGGACCGTCAGTCTTCCTCTTCCCCCCAAAACCCA

AGGACACCCTCATGATCTCCCGGACCCCTGAGGTCACATGCGTGGTGGTG

AGCGTGAGCCACGAAGACCCTGAGGTCAAGTTCAACTGGTACGTGGACGG

CGTGGAGGTGCATAATGCCAAGACAAAGCCGCGGGAGGAGCAGTACAACA

GCACGTACCGTGTGGTCAGCGTCCTCACCGTCCTGCACCAGGACTGGCTG

AATGGCAAGGAGTACAAGTGCAAGGTGTCCAACAAAGCCCTCCCAGCCCC

CATCGAGAAAACCATCTCCAAAGCCAAAGGGCAGCCCCGAGAACCACAGG

TGTACGTGCTGCCCCCATCCCGGGAGGAGATGACCAAGAACCAGGTCAGC

CTGCTGTGCCTGGTCAAAGGCTTCTATCCCAGCGACATCGCCGTGGAGTG

GGAGAGCAATGGGCAGCCGGAGAACAACTACCTCACCTGGCCTCCCGTGC

TGGACTCCGACGGCTCCTTCTTCCTCTACAGCAAGCTCACCGTGGACAAG

TCCAGATGGCAGCAGGGGAACGTCTTCTCATGCTCCGTGATGCATGAGGC

TCTGCACAACCACTACACGCAGAAGTCTCTCTCCCTGTCTCCGGGAAAA

>P5MB898-LH-scFV DNA;

SEQ ID NO: 873

CAGTCTGTGCTGACCCAGCCTCCTTCTGTGTCTGCTGCTCCTGGCCAGAA

AGTGACCATCTCCTGCTCCGGCTCCTCCTCCAACATCGGCATCAACTACG

TGTCCTGGTATCAGCAGCTGCCCGGCACAGCTCCCAAACTGCTGATCTAC

GACAACAACAAGCGGCCCAGCGGCATCCCTGACAGATTCTCCGGATCTAA

GTCCGGCACCTCTGCTACCCTGGGCATCACAGGATTGCAGACAGGCGACG

AGGCCGACTACTATTGCGGCACCTGGGACTCTTCTCTGTCCGCCGTTGTT

TTTGGTGGAGGCACCAAGCTGACAGTGCTCGGCGGCTCCGAGGGCAAGAG

CAGCGGCAGCGGCAGCGAGAGCAAGAGCACCGGCGGCAGCGAGGTGCAGC

TGGTTGAATCTGGCGGAGGATTGGTTCAGCCTGGCGGTTCTCTGAGACTG

TCTTGTGCCGCTTCCGGCTTCACCTTCTCCAGCTACGCTATGTCCTGGGT

CCGACAGGCTCCTGGCAAAGGACTGGAATGGGTGTCCGCTATCTCTGGCG

GATCCGGCTCTACCTACTACGCCGACTCTGTGAAGGGCAGATTCACCATC

AGCCGGGACAACTCCAAGAACACCCTGTACCTGCAGATGAACTCCCTGAG

AGCCGAGGACTCCGCCGTGTACTACTGTGCTAAAGATGGCGTGGGCGCTA

CCCCTTACTACTTCGATTATTGGGGCCAGGGCACCCTGGTCACCGTTTCT

TCTGAGCCCAAATCTAGCGACAAAACTCACACTTGTCCACCGTGCCCAGC

ACCTGAAGCAGCAGGGGGACCGTCAGTCTTCCTCTTCCCCCCAAAACCCA

AGGACACCCTCATGATCTCCCGGACCCCTGAGGTCACATGCGTGGTGGTG

AGCGTGAGCCACGAAGACCCTGAGGTCAAGTTCAACTGGTACGTGGACGG

CGTGGAGGTGCATAATGCCAAGACAAAGCCGCGGGAGGAGCAGTACAACA

GCACGTACCGTGTGGTCAGCGTCCTCACCGTCCTGCACCAGGACTGGCTG

AATGGCAAGGAGTACAAGTGCAAGGTGTCCAACAAAGCCCTCCCAGCCCC

CATCGAGAAAACCATCTCCAAAGCCAAAGGGCAGCCCCGAGAACCACAGG

TGTACGTGCTGCCCCCATCCCGGGAGGAGATGACCAAGAACCAGGTCAGC

CTGCTGTGCCTGGTCAAAGGCTTCTATCCCAGCGACATCGCCGTGGAGTG

GGAGAGCAATGGGCAGCCGGAGAACAACTACCTCACCTGGCCTCCCGTGC

TGGACTCCGACGGCTCCTTCTTCCTCTACAGCAAGCTCACCGTGGACAAG

TCCAGATGGCAGCAGGGGAACGTCTTCTCATGCTCCGTGATGCATGAGGC

-continued

TCTGCACAACCACTACACGCAGAAGTCTCTCTCCCTGTCTCCGGGAAAA

Example 6.3: Preparation of Anti-PSMA/Anti-Vβ17 Bispecific Antibodies

The anti-PSMA/anti-Vβ17 antibody was generated by co-expression of the anti-Vb17 knob heavy chain and light chain (LC) with the anti-PSMA heavy chain B. The anti-Vb17 with humanized variable region further modified by mutation of N33S in the light chain CDR1 variable domain to remove a deamidation risk was used to generate the bispecific antibodies.

The designed heavy chain molecules were synthesized into gblocks (IDT; Coralville, IA) containing 15 bp overlaps at the 5' and 3' ends for ligation independent cloning using InFusion method (ClonTech). All light chain constructs were inserted into pLonza vector containing the BswiI and HindIII restriction sites for in-frame ligation to the human kappa constant domain. Murine IgH signal peptides were encoded to allow for efficient secretion of mAbs into culture supernatant. All gblocks were reconstituted in sterile water and incubated at 50° C. for 10 minutes as per manufacturer protocol. pLonza vector (Lonza; Basel, Switzerland) was linearized using EcoRI and HindIII followed by gel extraction and cleanup. A 2:1 mass ratio of linearized vector to insert was used followed by heat pulse at 50° C. for 15 minutes. The infusion reactions were transformed into Stellar competent cells (ClonTech) and resultant colonies were scaled for miniprep. All constructs were sequence verified and scaled up using Endotoxin free maxi preparation kits (Qiagen; Hilden, Germany).

The VH amino acid sequence of the Vβ17 antibody used is SEQ ID NO: 21. The VL amino acid sequences of the Vβ17 antibody used is SEQ ID NO: 23 and SEQ ID NO: 677. The VH nucleotide sequences of the anti-Vβ17 antibodies is SEQ ID NO: 715. The VL nucleotide sequences of the anti-Vβ17 antibodies is SEQ ID NO: 716.

TABLE 42

Kabat CDR Sequences/SEQ ID NOs of bispecific anti-PSMA/anti-vβ17 antibodies

| Bispecific antibody name | Parental (PSMA arm/vb17 arm) | HCDR1 | HCDR2 | HCDR3 | LCDR1 | LCDR2 | LCDR3 |
|---|---|---|---|---|---|---|---|
| VB17B3 | PSMB895-LH-scFV | 738 | 739 | 740 | 741 | 742 | 743 |
|  | Vb17-LC-N33S-Fab | SGYFWN (SEQ ID NO: 717) | 236 | 237 | 680 | 239 | 240 |
| VB17B4 | PSMB896-LH-scFV | 744 | 745 | 746 | 747 | 748 | 749 |
|  | Vb17-LC-N33S-Fab | SGYFWN (SEQ ID NO: 717) | 236 | 237 | 680 | 239 | 240 |
| VB17B5 | PSMB897-LH-scFV | 750 | 751 | 752 | 753 | 754 | 755 |
|  | Vb17-LC-N33S-Fab | SGYFWN (SEQ ID NO: 717) | 236 | 237 | 680 | 239 | 240 |
| VB17B6 | PSMB895-LH-scFV | 756 | 757 | 758 | 759 | 760 | 761 |
|  | Vb17-LC-N33S-Fab | SGYFWN (SEQ ID NO: 717) | 236 | 237 | 680 | 239 | 240 |
| VB17B25 | PSMB410 | 901 | 902 | 903 | 904 | 905 | 906 |
|  | B17B21-N33S | 717 | 236 | 237 | 680 | 239 | 240 |
| PSMB2951 | PSMB410 | 901 | 902 | 903 | 904 | 905 | 906 |
|  | B21M | TSGMGVS (SEQ ID NO: 936) | HIYWDDD KRYNPSL KS (SEQ ID NO: 937) | LYGFTYG FAY (SEQ ID NO: 938) | RASQSV DYNGIS YMH (SEQ ID NO: 939) | AASNPES (SEQ ID NO: 940) | QQIIEDP WT (SEQ ID NO: 941) |

TABLE 43

HC and LC amino acid sequences of anti-PSMA/anti-Vβ17 antibodies.

| | PSMA arm | | | Vβ17 arm | | |
|---|---|---|---|---|---|---|
| Bispecific Name | Name | HC1 or scFv-Fc SEQ ID NO: | LC1 SEQ ID NO: | Name | HC2 or scFv-Fc SEQ ID NO: | LC2 SEQ ID NO: |
| VB17B3 | PSMB895-LH-scFV | 866 | N/A | Vb17-LC-N33S-Fab | 722 | 723 |
| VB17B4 | PSMB896-LH-scFV | 867 | N/A | Vb17-LC-N33S-Fab | 722 | 723 |
| VB17B5 | PSMB897-LH-scFV | 868 | N/A | Vb17-LC-N33S-Fab | 722 | 723 |
| VB17B6 | PSMB898-LH-scFV | 869 | N/A | Vb17-LC-N33S-Fab | 722 | 723 |
| VB17B25 | PSMB410 | 931 | N/A | B17B21-N33S | 932 | 933 |
| PSMB2951 | PSMB410 | 931 | N/A | B21M | 934 | 935 |

The amino acid sequences of the Vβ17 arm of selected anti-Vβ17 antibodies listed in Table 43 are shown below.

>B17B21-N33S HC2 Amino Acid;
SEQ ID NO: 932
(SEQ ID NO: 932)
QVQLQESGPGLVKPSETLSLTCTVSGYSITSGYFWNWIRQPPGKGLEWIG

YISYDGSNNYNPSLKSRVTISRDTSKNQFSLKLSSVTAADTAVYYCASPS

PGTGYAVDYWGQGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKKVEPKSCDKTHTCPPCPAPEAAGGPSVFLEPPKP

KDTLMISRTPEVTCVVVSVSHEDPEVKENWYVDGVEVHNAKTKPREEQYN

STYRVVSVLTVLHQDWLNGKEYKCKVSNKALPAPIEKTISKAKGQPREPQ

VYTLPPSREEMTKNQVSLSCAVKGFYPSDIAVEWESNGQPENNYKTTPPV

LDSDGSFELVSKLTVDKSRWQQGNVESCSVMHEALHNRFTQKSLSLSPGK

>B17B21-N335 LC2 Amino Acid;
SEQ ID NO: 933
(SEQ ID NO: 933)
DIQMTQSPSSLSASVGDRVTITCRSSQSLVHSSGNTYLHWYQQKPGKAPK

FLIYKVSNRFSGVPSRFSGSGSGTDFTLTISSLQPEDFATYYCSQSTHVP

FTFGQGTKLEIKRTVAAPSVFIFPPSDEQLKSGTASVVCLLNNFYPREAK

VQWKVDNALQSGNSQESVTEQDSKDSTYSLSSTLTLSKADYEKHKVYACE

VTHQGLSSPVTKSFNRGEC

>B21M HC2 Amino Acid;
SEQ ID NO: 934
(SEQ ID NO: 934)
QITLKESGPTLVKPTQTLTLTCTFSGESLSTSGMGVSWIRQPPGKALEWL

AHIYWDDDKRYNPSLKSRLTITKDTSKNQVVLTMTNMDPVDTATYYCARL

YGETYGFAYWGQGTLVTVSSASTKGPSVFPLAPSSKSTSGGTAALGCLVK

DYFPEPVTVSWNSGALTSGVHTFPAVLQSSGLYSLSSVVTVPSSSLGTQT

YICNVNHKPSNTKVDKKVEPKSCDKTHTCPPCPAPEAAGGPSVFLEPPKP

KDTLMISRTPEVTCVVVSVSHEDPEVKENWYVDGVEVHNAKTKPREEQYN

STYRVVSVLTVLHQDWLNGKEYKCKVSNKALPAPIEKTISKAKGQPREPQ

VYTLPPSREEMTKNQVSLSCAVKGFYPSDIAVEWESNGQPENNYKTTPPV

LDSDGSFELVSKLTVDKSRWQQGNVESCSVMHEALHNRFTQKSLSLSPGK

>B21M LC2 Amino Acid;
SEQ ID NO: 935
(SEQ ID NO: 935)
DIVMTQSPDSLAVSLGERATINCRASQSVDYNGISYMHWYQQKPGQPPKL

LIYAASNPESGVPDRFSGSGSGTDFTLTISSLQAEDVAVYYCQQIIEDPW

TFGQGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEV

THQGLSSPVTKSFNRGEC

TABLE 44

HC and LC DNA sequences of anti-PSMA/anti-Vβ17 antibodies.

| | PSMA arm | | | Vβ17 arm | | |
|---|---|---|---|---|---|---|
| Bispecific Name | Name | HC1 or scFv-Fc SEQ ID NO: | LC1 SEQ ID NO: | Name | HC2 or scFv-Fc SEQ ID NO: | LC2 SEQ ID NO: |
| VB17B3 | PSMB895-LH-scFV | 870 | N/A | Vb17-LC-N33S-Fab | 728 | 729 |
| VB17B4 | PSMB896-LH-scFV | 871 | N/A | Vb17-LC-N33S-Fab | 728 | 729 |
| VB17B5 | PSMB897-LH-scFV | 872 | N/A | Vb17-LC-N33S-Fab | 728 | 729 |
| VB17B6 | PSMB898-LH-scFV | 873 | N/A | Vb17-LC-N33S-Fab | 728 | 729 |

Example 6.4: Characterization of Anti-PSMA/Anti-Vβ17 Bispecific Antibodies

Example 6.4.1. Bispecific PSMA×Vβ17 Mediated Cytotoxicity Against PMSA⁺ Target Cell Lines in Pan-T Cells One PSMA⁺ cell line, C42b, was used at Effector to Target ratio (E:T):10:1. On day 0 of the experiment, 12 xCelligence plates were blanked with 50 µl of growth media and were then seeded with 20,000 C42b cells per well. These plates were then incubated on the xCelligence machine overnight. On day 1 of the experiment, three PAN-T donors were used for each bispecific anti-PSMA×Vβ17 antibody. 50 µl of 4×106/ml PAN-T cells (200,000 cells) was added into one C42b plate. Then 50 µl of the bispecific anti-PSMA×Vβ17 antibodies were added to the appropriate wells for each plate. The final bispecific antibody concentrations were 150 nM, 30 nM, 6 nM, 1.2 nM and 0.24 nM, respectively. The plates were then placed in the xCelligence machine and impedance was recorded every 15 minutes for 120 hours. The percent cytolysis was calculated on the RTCA software and was calculated based on tumor cells only (C42b).

The cell cytolysis mediated by four different bispecific anti-PSMA×Vβ17 antibodies under different conditions are shown in FIGS. 21A-21D and summarized in Table 45 below. The percent of Vβ17 under each condition and its corresponding E:T ratio are also included in Table 45.

Example 6.4.2. Binding of Vβ17×PSMA Antibodies on Pan T Cells

Binding assay was done with isolated Pan T cells from 2 donors. Pan T cells were isolated from Whole PBMCs. 1 µL Live dead (1:1000 diluted) and Fc Block 2 µL/well was added. 100 µL of the cell suspension was seeded in 96 well V bottom plate at 100,000 cell per well and incubated for 10 minutes at 4° C. The plate was washed by adding 190 µL FACS buffer spun at 1500 rpm for 5 minutes. 100 diluted test antibodies was added to the plate and the plate was incubated at 37° C. 5% $CO_2$ for 45 minutes. Wash step was repeated. 100 µL diluted Secondary antibody (0.5 µL/well in 100 µL FACS buffer) was added and the plate was incubated at 4° C. for 45 minutes. Wash step was repeated. 100 µL cytofix was added to the pellet and the plate was incubated at 4° C. for 10 minutes. Wash step was repeated. 100 FACS buffer was added to the pellet and sample was analyzed by Flow cytometry. Cells were gated on FSC/SSC, followed by live cell gating.

Figure 22A:
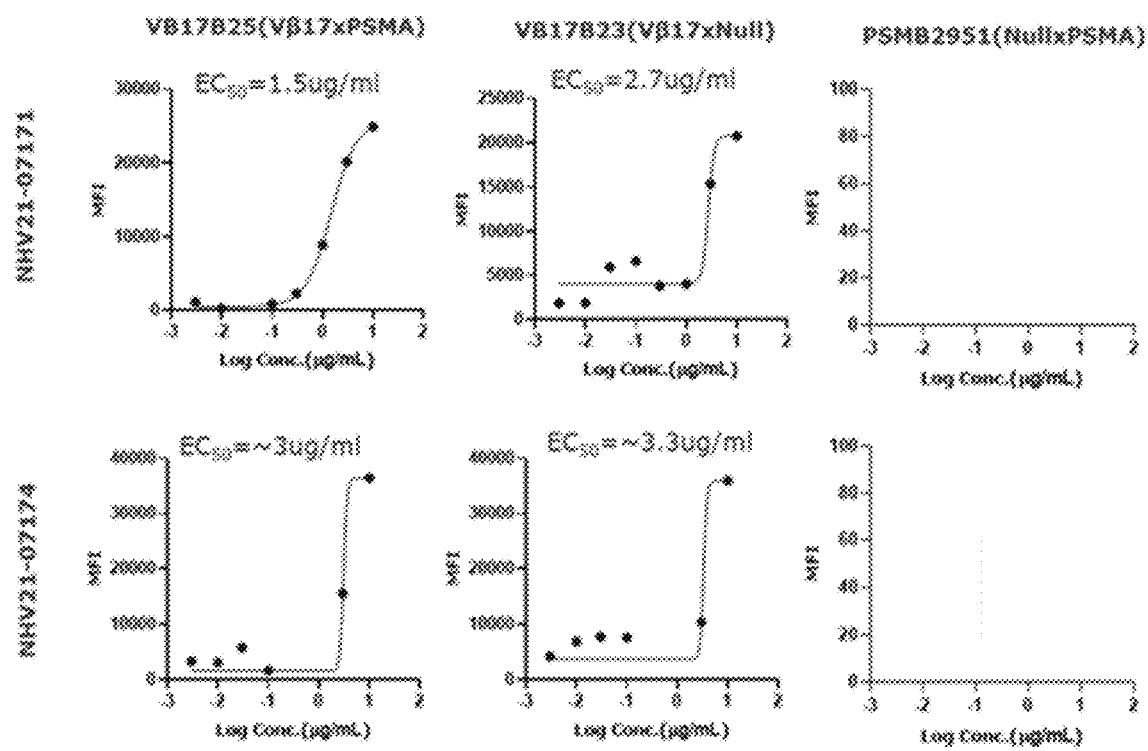
FIGS. 22A-22B show binding of Vβ17×PSMA antibodies on Pan T Cells.
Figure 22B:
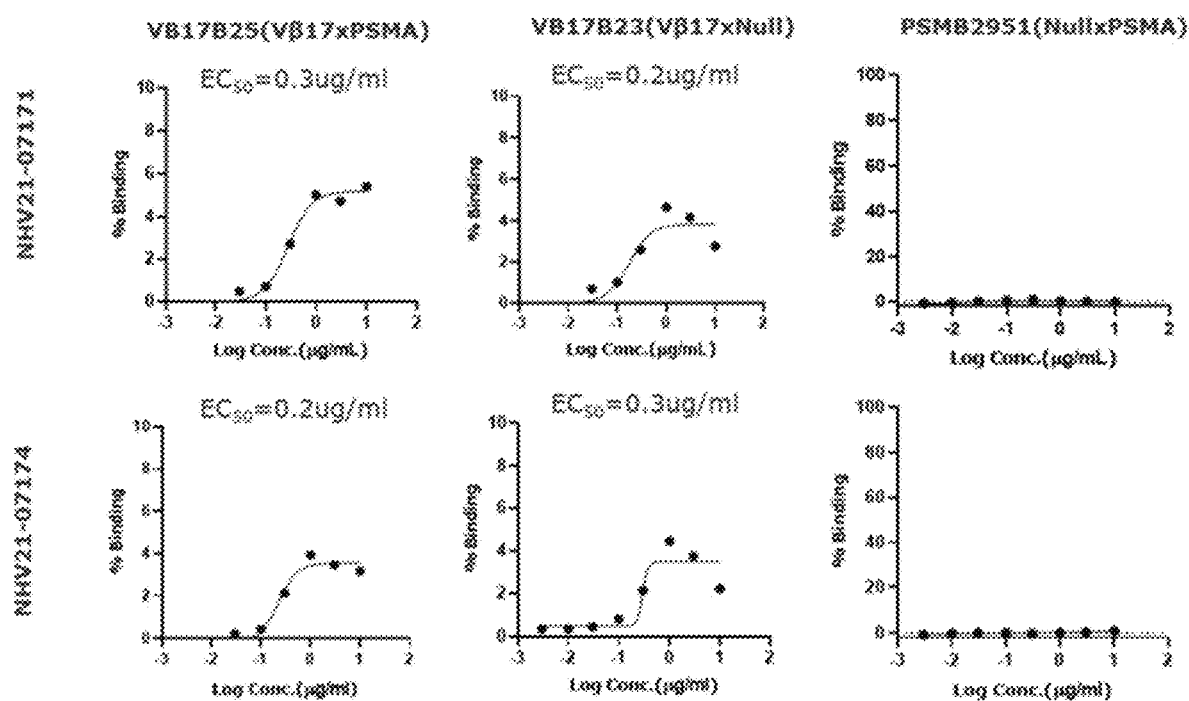

As shown in FIG. 22A, wherein binding was quantified based on MFI values, both donors NHV21-07171 and NHV-07174 showed good binding of VB17B25 (Vβ17×PSMA) on Pan T cells. No binding of PSMB2951 (null×PSMA) antibody was observed on Pan T cells. Similarly, as shown in FIG. 22B, wherein binding is quantified based on %

TABLE 45

Cell Cytolysis Mediated by Bispecific Anti-PSMA x Vβ17 Antibodies under Different Conditions

| Donor Information | | | | | Cytolysis | | | | |
|---|---|---|---|---|---|---|---|---|---|
| Donor ID | Vβ17 % | E:T (Vb17) | Molecules Name | Description | 150 nM | 30 nM | 6 nM | 1.2 nM | 0.24 nM |
| 1 | 5.12% | 0.5:1 | VB17B3 | PSMB895 × Vβ17 | 100% | 100% | 100% | 100% | ~25% |
| | | | VB17B4 | PSMB896 × Vβ17 | 100% | 100% | 100% | 100% | 100% |
| | | | VB17B5 | PSMB897 × Vβ17 | 100% | 100% | ~93% | 0% | 0% |
| | | | VB17B6 | PSMB898 × Vβ17 | 100% | 100% | 100% | 100% | 100% |
| 2 | 3% | 0.3:1 | VB17B3 | PSMB895 × Vβ17 | 100% | 100% | 100% | 100% | 100% |
| | | | VB17B4 | PSMB896 × Vβ17 | 100% | 100% | 100% | 100% | 100% |
| | | | VB17B5 | PSMB897 × Vβ17 | 100% | 100% | 100% | ~50% | 0% |
| | | | VB17B6 | PSMB898 × Vβ17 | 100% | 100% | 100% | 100% | 100% |
| 3 | 5.07% | 0.5:1 | VB17B3 | PSMB895 × Vβ17 | 100% | 100% | 100% | 100% | 100% |
| | | | VB17B4 | PSMB896 × Vβ17 | 100% | 100% | 100% | 100% | 100% |
| | | | VB17B5 | PSMB897 × Vβ17 | 100% | 100% | 100% | ~90% | 0% |
| | | | VB17B6 | PSMB898 × Vβ17 | 100% | 100% | 100% | 100% | 100% |

As shown in FIGS. 21A-21D and Table 45, all four bispecific anti-PSMA×Vβ17 exhibited high cytotoxicity at 10:1 E:T (PAN-T) for almost every concentration for all three donors. A dose response was observed for Vβ17×PSMA vertical line at approximately 23 hours, representing the beginning of the co-culture of the T cells, the bispecific antibodies and the tumor cells.

binding, both donors NHV21-07171 & NHV-07174 showed good binding of VB17B25 (Vβ17×PSMA) and VB17B23 (Vβ17×Null) antibodies on Pan T cells. No binding of PSMB2951 (Null×PSMA) antibody was observed on Pan T cells.

Example 6.4.3. Binding of Vβ17×PSMA Antibodies on C42B Cells

The C4-2B cells were centrifuged and re-suspended in DPBS and counted. 4 million cells were re-suspended in 8 mL of DPBS and 8 µL of Violet Fluorescent Dye was added and incubated for 15 min. in 4° C. Eight milliliters FACS buffer was added to neutralize mix and 200 µL per well was seeded. The plate was centrifuged and re-suspended in 100 µL of antibody dilutions accordingly and incubated for 30 min. in incubator. 10 µg/mL conc. of each antibodies were prepared in 200 µL stock and further diluted to 8 points by adding 60 µL to 120 µL of FACS serially buffer to get 3-fold dilution. 100 µL of FACS buffer were added to each well, centrifuged, re-suspended in 100 µL FACS buffer with 0.5 µL/well con. Secondary antibody tagged with APC & incubated for 30 min. 4° C. Next, 100 µL of FACS buffer was added to each well, centrifuged, re-suspended in 100 µL BD Cytofix & incubated for 10 min. 4° C. 100 µL of FACS buffer were added to each well, centrifuged, re-suspended in 100 µL FACS buffer, stored at 4° C. Data was acquired in Flow cytometer and the data was analyzed.

Figure 23:
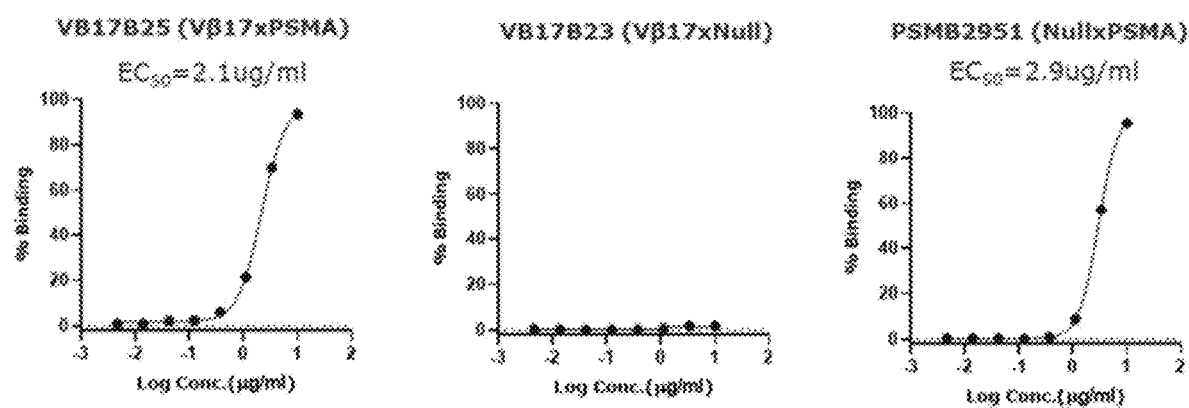
FIG. 23 shows binding of Vβ17×PSMA antibodies on C42B cells. Binding of VB17B25 (Vβ17×PSMA) and PSMB2951 (Null×PSMA) was observed. No binding was observed with VB17B23 (Vβ17×Null) antibodies on C4-2B cells.

Binding of VB17B25 (Vβ17×PSMA) was observed with an $EC_{50}$ of 2.1 µg/mL, and of PSMB2951 (Null×PSMA) with $EC_{50}$ of 3. 9 µg/mL on C4-2B cells as shown in FIG. 23. No binding was observed with VB17B23 (Vβ17×Null) antibodies on C4-2B cells.

Example 6.4.4. Cytotoxicity Mediated by Vβ17×PSMA Bispecific Antibodies Against C4-2B Cells On day zero 904, (5,000 C42B-NLR-N #4 cell) was seeded per well. The plate was incubated at 37° C. 5% $CO_2$ overnight. On day 1 the Vβ17 expression was checked on whole PBMCS and Pan T cells. 90 µL PBMCs and Pan T cells were added in RPMI at 1:1 E:T ratio. 204, of 10× diluted test antibodies was added. The plate was mixed by shaking with hand. Bubbles in the wells were broken by bubble baker, the lower surface of the plate was cleaned and the plate was incubated at 37° C. with 5% $CO_2$ for 15 minutes. After 15 minutes incubation plates were checked for fogging and cleaned if needed. The plates were transferred into Incucyte instrument. Appropriate settings for scheduled scan was given on Incucyte and incubated for 96 h or 120 h. Cytotoxicity was monitored using Incucyte as a decrease in the red fluorescence signal intensity.

Figure 24A:
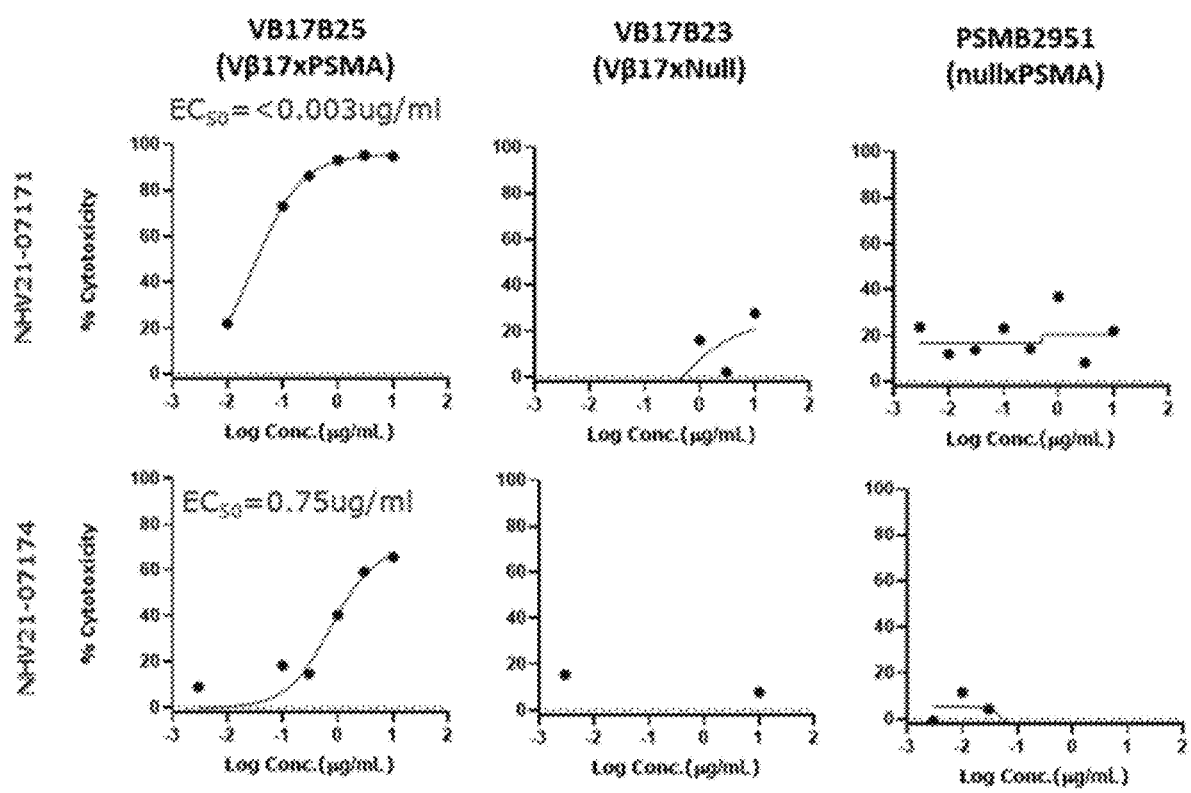
FIGS. 24A-24D show cytotoxicity mediated by Vβ17× PSMA bispecific antibodies against C4-2B cells.
Figure 24B:
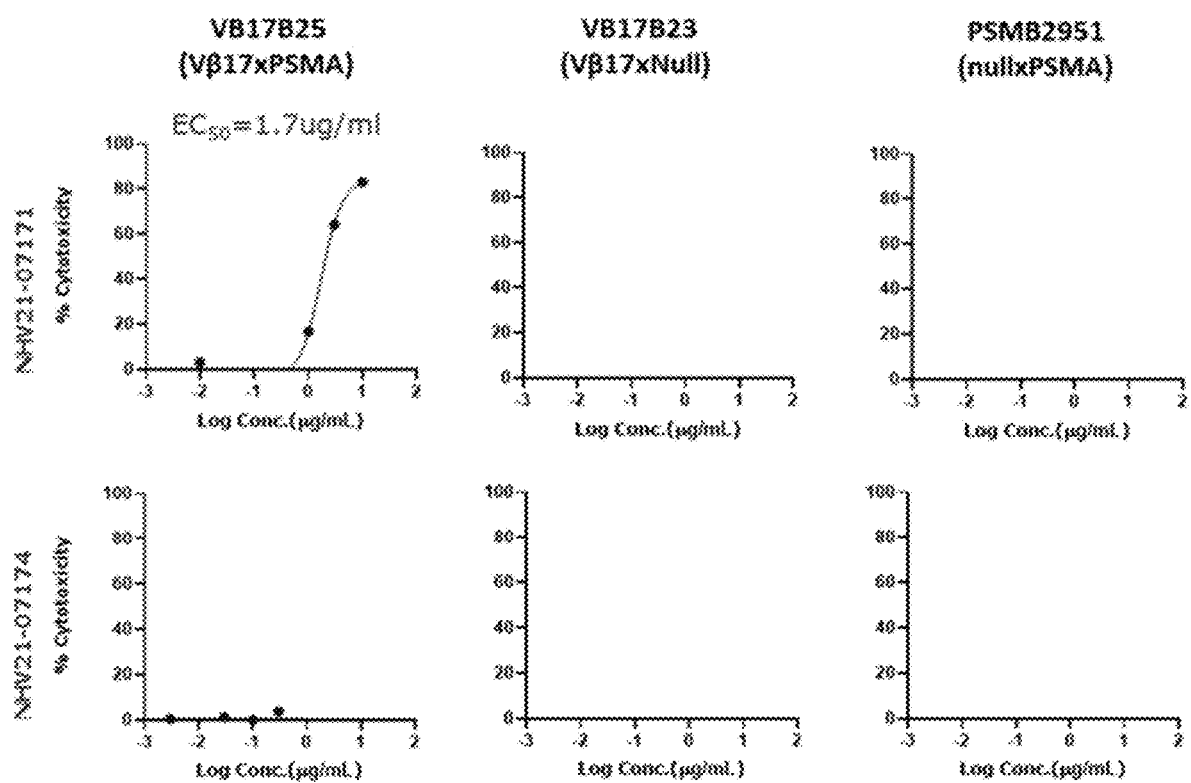

As shown in FIG. 24A, with whole PBMCs as effector cells, both donors showed potent dose dependent cytotoxicity against C4-2B cells with VB17B25 antibodies. No cytotoxicity was observed with the respective Null antibodies (VB17B23 and PSMB2951). As shown in FIG. 24B, with Pan T cells as effector cells, donor NHV21-07171 showed potent dose dependent cytotoxicity against C4-2B cells with VB17B25 antibodies. No cytotoxicity was observed with the respective Null antibodies (VB17B23 and PSMB2951). No cytotoxicity was observed with the second donor (NHV21-07174) with the VB17B25 antibody.

Figure 24C:
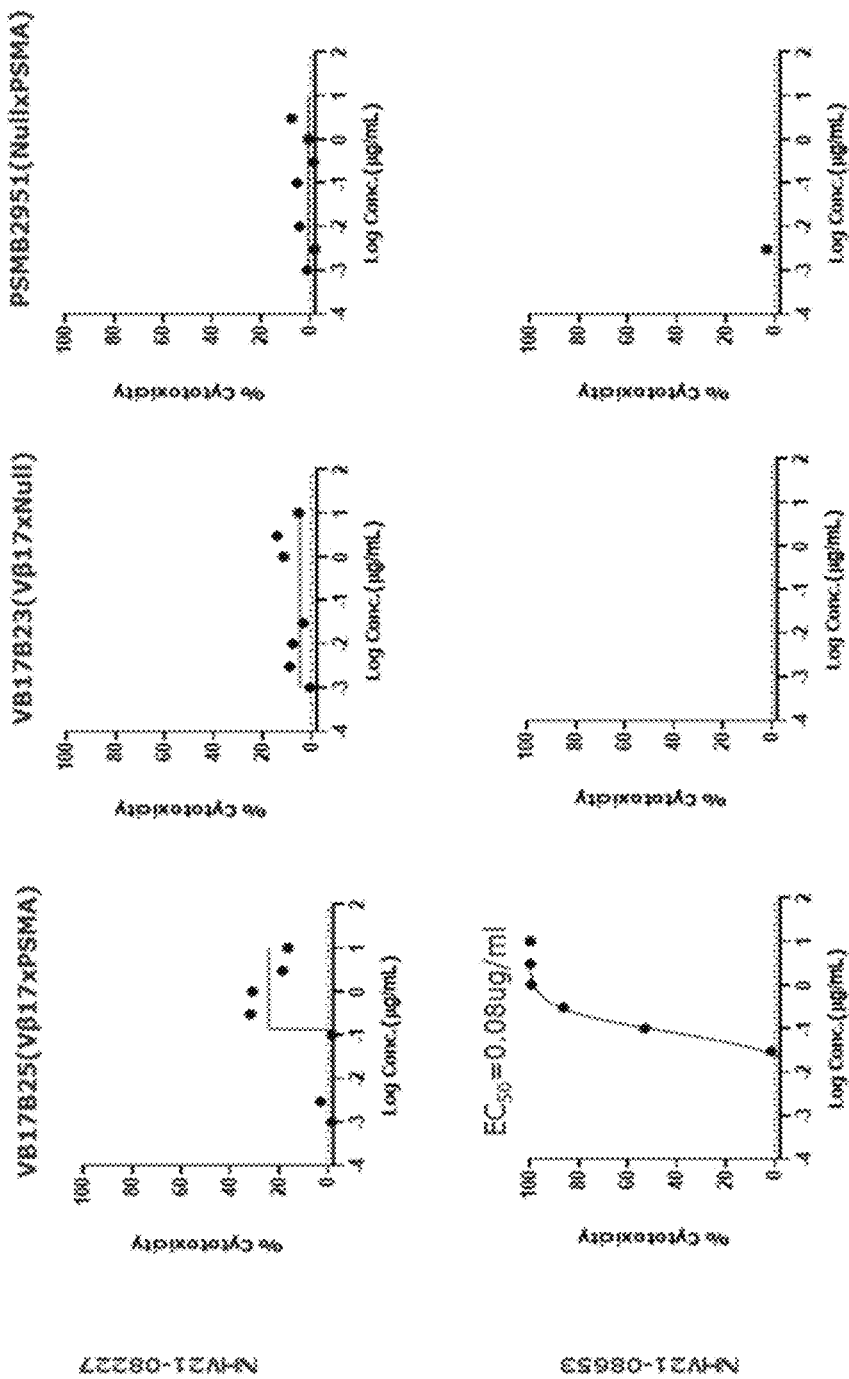
Figure 24D:
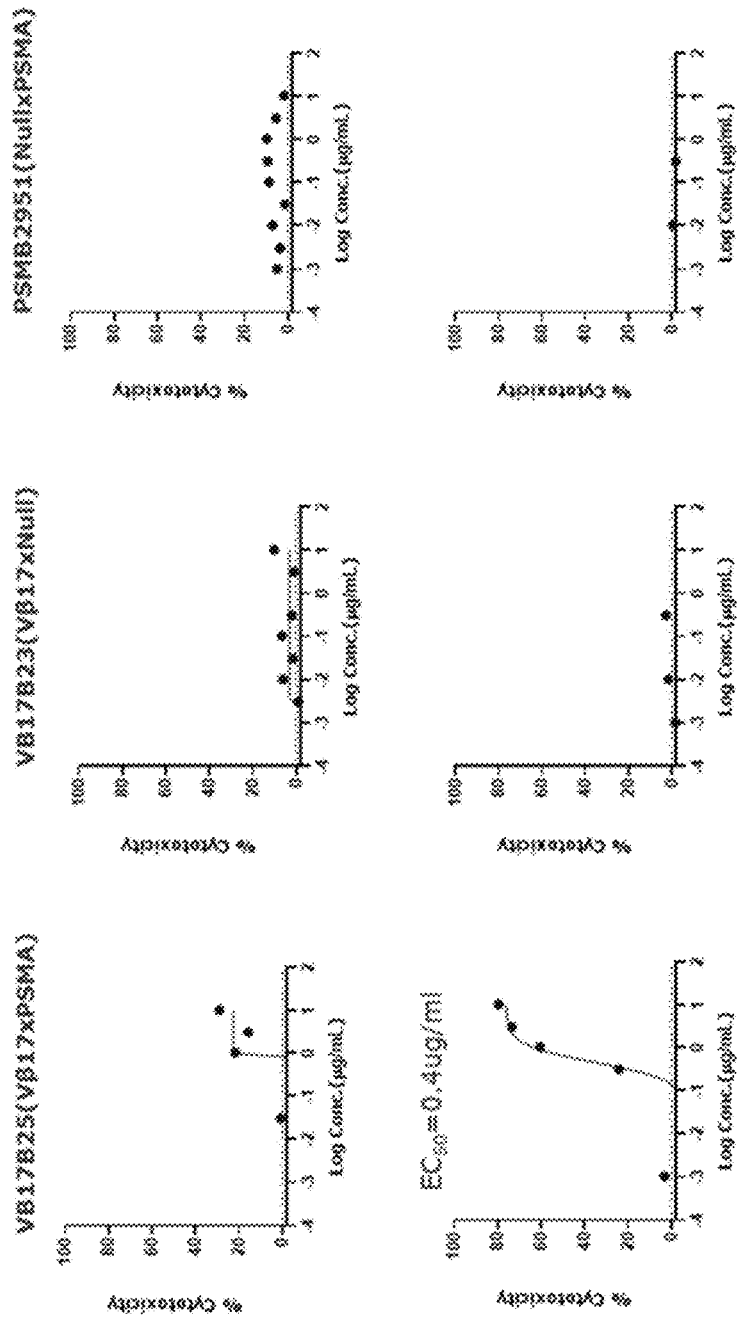

Two additional donors were tested for Vβ17×PSMA antibody with whole PBMCs and Pan T cells as the effector cells. As shown in FIG. 24C for whole PBMCs as effector cells, both donors showed cytotoxicity against C4-2B cells, although donor NHV21-08227 showed only 20% max lysis of target cells. Donor NHV21-08653 showed potent cytotoxicity. Similar to what was observed with whole PBMCs as effector cells, with Pan T cells as the effector cells, both donors showed cytotoxicity against C4-2B cells, although donor NHV21-08227 showed only 20% max lysis of target cells as shown in FIG. 24D. Donor NHV21-08653 showed potent cytotoxicity.

Example 6.4.5. T Cell Activation Mediated by Vβ17×PSMA Bispecific Antibodies Whole PBMCs and Pan T cells were cultured with C4-2B target cells in the presence of 10 µg/mL top concentration followed by 3 fold dilution up to 0.4 µg/mL of bispecifics for 72 hrs. Cells were harvested at 72 h time point and CD25 and CD71 was analyzed by gating on CD3+ T cells. In detail, on day zero 2504, (30,000 C42B-WT) was seeded. The plate was incubated at 37° C. with 5% $CO_2$ overnight to get the cells adhere to the surface. On day 1 the Vβ17 expression on whole PBMCS and Pan T cells was checked. 00 µL PBMCs and Pan T cells were added in RPMI at 1:1 E:T ratio. 504, of 8× diluted test antibodies were added. The plate was incubated at 37° C. 5% $CO_2$ Incubator. Time points were assessed at 48 h, 72 h, and 96 h. For each time point cells are seeded separately. After each time point the supernatants was collected by spinning the plates at 1800 rpm for 5 minutes. 2004, PBS mix was added vigorously with pipette. The cell suspension was transferred into 96 well v bottom plate and the plate was spun at 1800 rpm for 5 minutes. The supernatant was discarded. To the pellet, 100 µL of diluted (1:1000) live dead dye and FC-Block (2 µL/well) was added and incubated for 10 minutes at 40° C. The plate was washed by adding 180 µL FACS buffer to each well and spun at 1800 rpm for 5 minutes. 1004, of antibody cocktail was added to the plate and the plate was incubated at 4° C. for 45 minutes. The wash step was repeated. 1004, fixative buffer was added to the pellet and incubated for 30 minutes at 4° C.

Figure 25:
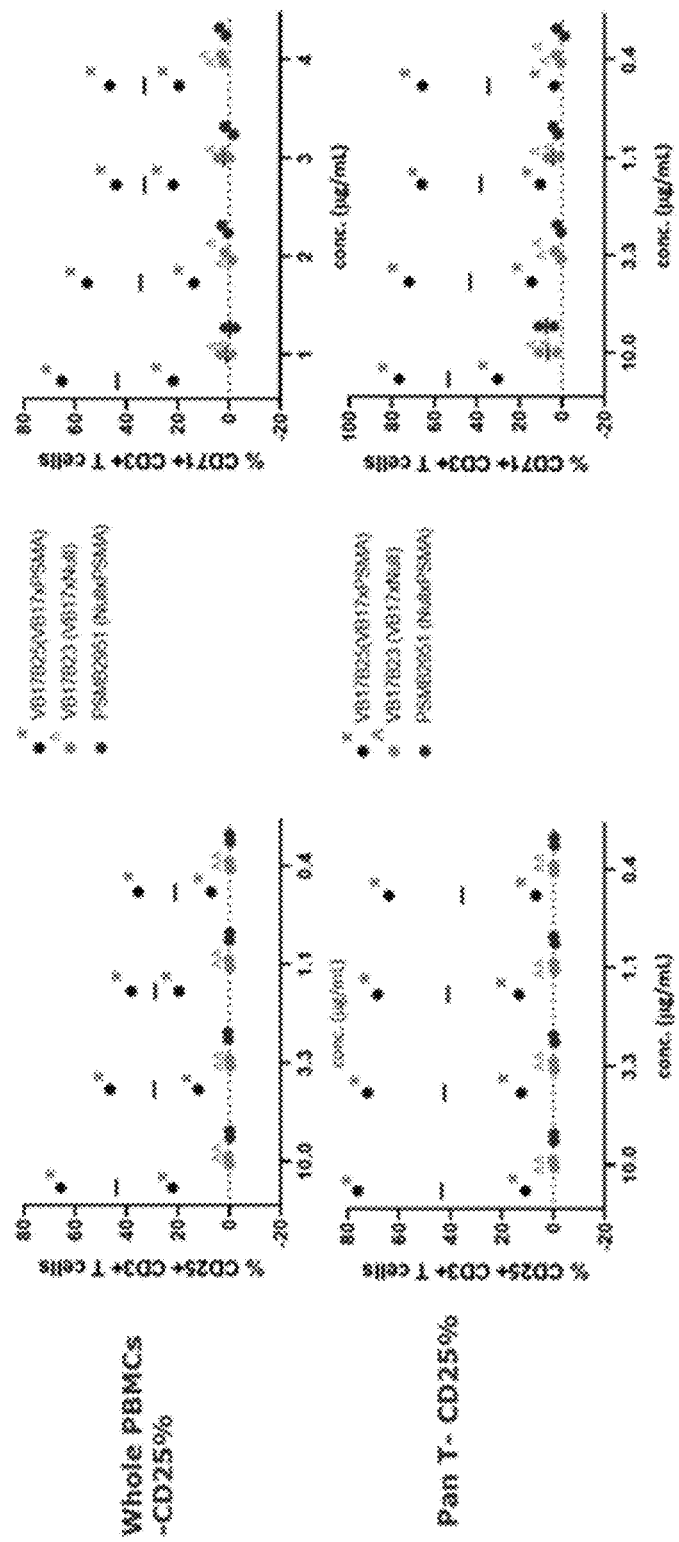
FIG. 25 shows T cell activation mediated by Vβ17× PSMA bispecific antibodies. Whole PBMCs and Pan T cells were cultured with C4-2B target cells in the presence of 10 µg/mL top concentration followed by 3 fold dilution up to 0.4 µg/mL of bispecifics for 72 hrs. Cells were harvested at 72 hrs. time point and CD25 and CD71 was analyzed by gating on CD3 T cells.

As shown in FIG. 25, increased expression of CD25 and CD71 activation marker on Vβ17 T cells treated with VB17B25 (Vβ17×PSMA) antibody was observed only with NHV21-07171. Activation was also observed for the second donor although at lower levels. No activation of T cells was observed with the Null control antibody.

Example 7—Bispecific Antibodies that Bind Vβ17 and KLK2

Example 7.1: Generation of Anti-KLK2 Antibodies and scFv

The OmniRat® contains a chimeric human/rat IgH locus (comprising 22 human VHs, all human D and JH segments in natural configuration linked to the rat CH locus) together with fully human IgL loci (12 Vκs linked to Jκ-Cκ and 16 Vλs linked to Jλ-Cλ) (see, e.g., Osborn, et al., *J Immunol*, 2013, 190(4): 1481-90). Accordingly, the rats exhibit reduced expression of rat immunoglobulin, and in response to immunization, the introduced human heavy and light chain transgenes undergo class switching and somatic mutation to generate high affinity chimeric human/rat IgG monoclonal antibodies with fully human variable regions. The preparation and use of OmniRat®, and the genomic modifications carried by such rats, is described in International Publication No. WO14/093908.

Ablexis® mice generate antibodies having human variable domains linked to human CH1 and CL domains, chimeric human/mouse hinge regions, and mouse Fc regions. Ablexis Kappa Mouse and Lambda Mouse strains are distinguished by which of their heavy chains are human or mouse as noted below. Antibodies produced by the Kappa Mouse lack sequences derived from mouse VH, DH and JH exons and mouse Vκ, Jκ and Cκ exons. The endogenous mouse Igλ is active in the Kappa Mouse. The human Igκ chains comprise approximately 90-95% of the naïve repertoire and mouse Igλ chains comprise approximately 5-10% of the naïve repertoire in this strain. Antibodies produced by the Lambda Mouse lack sequences derived from mouse VH, DH and JH exons and mouse Vλ, Jλ and Cλ exons. The endogenous mouse Igκ is active in the Lambda Mouse. The human Igλ chains comprise approximately 40% of the naïve repertoire and mouse Igκ chains comprise approximately 60% of the naïve repertoire. The preparation and use of Ablexis®, and the genomic modifications carried by such mice, is described in International Publication No. WO11/123708.

Ablexis® mice and OmniRats® rats are immunized with soluble full length KLK2 protein (human kallikrein-2 6-His protein, with an amino acid sequence of (SEQ ID NO: 874)
VPLIEGRIVGGWECEKHSQPWQVAVYSHGWAHCGGVLVHPQWVLTAAHCL

KKNSQVWLGRHNLFEPEDTGQRVPVSHSFPHPLYNMSLLKHQSLRPDEDS

SHDLMLLRLSEPAKITDVVKVLGLPTQEPALGTTCYASGWGSIEPEEFLR

PRSLQCVSLHYSEKVTEFMLCAGLWTGGKDTCGGDSGGPLVCNGVLQGIT

SWGPEPCALPEKPAVYTKVVHYRKWIKDTIAANPHHHHHH.

Lymphocytes from Ablexis® mice and OmniRats® rats are extracted from lymph nodes and fusions performed by cohorts. Cells are combined and sorted for CD138 expression. Hybridoma screening is performed in high throughput miniaturized MSD format using soluble hKLK2 antigen. Approximately more than 300 samples are identified to be KLK2 binders. The binding of more than 300 anti-hKLK2 supernatant samples to human KLK2 protein is measured by a single cycle kinetics method using the Biacore™ 8K SPR System. Additionally the supernatant samples are tested for binding to human KLK3 protein, and to KLK2 expressing cell lines VCap and negative control cell line DU145 by flow cytometry.

Selected binders are subject to scFv conversion in both VH-VL and VL-VH orientation and tested for thermostability. Binary combinatorial scFv libraries are generated in the orientation VH-linker-VL in which one of the variable regions comprised sequences of the combinatorial library and the other variable region comprised the sequence of the parental KL2B30 VH or VL. A linker with a sequence of GGSEGKSSGSGSESKSTGGS (SEQ ID NO:690) is used to conjugate the VH/VL regions. The engineered scFvs are cloned and expressed in *E. coli*. The scFvs resulting from the supernatants are tested for binding to human KLK2 by ELISA, which binding is compared to that of the KL2B30 antibody. Any new variants exhibiting binding affinities comparable to that of KL2B30 are consolidated and further tested for binding to human KLK2 after incubating the *E. coli* culture supernatants at 55° C., 60° C., and 65° C. for 10 minutes. The molecules retaining comparable binding to hu11B6 after incubation at 55° C., 60° C., and 65° C. and improved thermostability are matrixed in both orientations (VH-linker-VL; VL-linker-VH) and converted to mammalian scFvs for further characterization as described below.

KL2B30 is generated as a result of the Ablexis® mice immunization campaign, and expressed in a Fab format, a mAb format, a scFv format in the VH-linker-VL orientation or a scFv format in VL-linker-VH orientation and are further analyzed as described below. The linker sequence of SEQ ID NO: 166 is used to conjugate the VH/VL regions.

Sequences of KL2B30 antibodies and their variants are summarized in the Table 46 below.

TABLE 46

Amino acid and nucleotide sequences of KL2B30 antibodies and variants

| Antibody Name | Region/Description | Complete Sequence (SEQ ID NO) |
|---|---|---|
| KL2B30 | VH/Amino Acid Sequence | QVQLQESGPGLVKPSETLSLTCTVSGGSISSYYWSWIRQPPGKGLEWI GYIYYSGSTNYNPSLKSRVTISVDTSKNQFSLKLSSVTAADTAVYYCA GTTIFGVVTPNFYYGMDVWGQGTTVTVSS (SEQ ID NO: 875) |
| KL2B30 | VL/Amino Acid Sequence | DIQMTQSPSFLSASVGDRVTITCRASQGISSYLAWYQQKPGKAPKFLI YAASTLQSGVPSRFSGSGSGTEFTLTISSLQPEDFATYYCQQLNSYPL TFGGGTKVEIK (SEQ ID NO: 876) |
| KL2B30 | Heavy Chain/Amino Acid Sequence | QVQLQESGPGLVKPSETLSLTCTVSGGSISSYYWSWIRQPPGKGLEWI GYIYYSGSTNYNPSLKSRVTISVDTSKNQFSLKLSSVTAADTAVYYCA GTTIFGVVTPNFYYGMDVWGQGTTVTVSSASTKGPSVFPLAPCSRSTS ESTAALGCLVKDYFPEPVTVSWNSGALTSGVHTFPAVLQSSGLYSLSS VVTVPSSSLGTKTYTCNVDHKPSNTKVDKRVESKYGPPCPPCPAPEAA GGPSVFLFPPKPKDTLMISRTPEVTCVVVDVSQEDPEVQFNWYVDGVE VHNAKTKPREEQFNSTYRVVSVLTVLHQDWLNGKEYKCKVSNKGLPSS IEKTISKAKGQPREPQVYTLPPSQEEMTKNQVSLTCLVKGFYPSDIAV EWESNGQPENNYKTTPPVLDSDGSFFLYSRLTVDKSRWQEGNVFSCSV MHEALHNHYTQKSLSLSLGK (SEQ ID NO: 877) |
| KL2B30 | Light Chain/Amino Acid Sequence | DIQMTQSPSFLSASVGDRVTITCRASQGISSYLAWYQQKPGKAPKFLI YAASTLQSGVPSRFSGSGSGTEFTLTISSLQPEDFATYYCQQLNSYPL TFGGGTKVEIKRTVAAPSVFIFPPSDEQLKSGTASVVCLLNNFYPREA KVQWKVDNALQSGNSQESVTEQDSKDSTYSLSSTLTLSKADYEKHKVY ACEVTHQGLSSPVTKSFNRGEC (SEQ ID NO: 878) |
| scFv41 | KL2B30_HL/Amino Acid Sequence | QVQLQESGPGLVKPSETLSLTCTVSGGSISSYYWSWIRQPPGKGLEWI GYIYYSGSTNYNPSLKSRVTISVDTSKNQFSLKLSSVTAADTAVYYCA GTTIFGVVTPNFYYGMDVWGQGTTVTVSSGGSEGKSSGSGSESKSTGG SDIQMTQSPSFLSASVGDRVTITCRASQGISSYLAWYQQKPGKAPKFL |

TABLE 46-continued

Amino acid and nucleotide sequences of KL2B30 antibodies and variants

| Antibody Name | Region/ Description | Complete Sequence (SEQ ID NO) |
|---|---|---|
| | | IYAASTLQSGVPSRFSGSGSGTEFTLTISSLQPEDFATYYCQQLNSYP LTFGGGTKVEIK (SEQ ID NO: 879) |
| scFv42 | KL2B30_LH/ Amino Acid Sequence | DIQMTQSPSFLSASVGDRVTITCRASQGISSYLAWYQQKPGKAPKFLI YAASTLQSGVPSRFSGSGSGTEFTLTISSLQPEDFATYYCQQLNSYPL TFGGGTKVEIKGGSEGKSSGSGSESKSTGGSQVQLQESGPGLVKPSET LSLTCTVSGGSISSYYWSWIRQPPGKGLEWIGYIYYSGSTNYNPSLKS RVTISVDTSKNQFSLKLSSVTAADTAVYYCAGTTIFGVVTPNFYYGMD VWGQGTTVTVSS (SEQ ID NO: 880) |
| KLCB80 (KL2B30 Fab) | Heavy Chain/ Amino Acid Sequence | QVQLQESGPGLVKPSETLSLTCTVSGGSISSYYWSWIRQPPGKGLEWI GYIYYSGSTNYNPSLKSRVTISVDTSKNQFSLKLSSVTAADTAVYYCA GTTIFGVVTPNFYYGMDVWGQGTTVTVSSASTKGPSVFPLAPSSKSTS GGTAALGCLVKDYFPEPVTVSWNSGALTSGVHTFPAVLQSSGLYSLSS VVTVPSSSLGTQTYICNVNHKPSNTKVDKKVEPKSCDKTHTCPPCPAP EAAGGPSVFLFPPKPKDTLMISRTPEVTCVVVSVSHEDPEVKFNWYVD GVEVHNAKTKPREEQYNSTYRVVSVLTVLHQDWLNGKEYKCKVSNKAL PAPIEKTISKAKGQPREPQVYVLPPSREEMTKNQVSLLCLVKGFYPSD IAVEWESNGQPENNYLTWPPVLDSDGSFFLYSKLTVDKSRWQQGNVFS CSVMHEALHNHYTQKSLSLSPG (SEQ ID NO: 881) |
| KL2B30 with K477 Fab | Heavy Chain/ Amino Acid Sequence | QVQLQESGPGLVKPSETLSLTCTVSGGSISSYYWSWIRQPPGKGLEWI GYIYYSGSTNYNPSLKSRVTISVDTSKNQFSLKLSSVTAADTAVYYCA GTTIFGVVTPNFYYGMDVWGQGTTVTVSSASTKGPSVFPLAPSSKSTS GGTAALGCLVKDYFPEPVTVSWNSGALTSGVHTFPAVLQSSGLYSLSS VVTVPSSSLGTQTYICNVNHKPSNTKVDKKVEPKSCDKTHTCPPCPAP EAAGGPSVFLFPPKPKDTLMISRTPEVTCVVVSVSHEDPEVKFNWYVD GVEVHNAKTKPREEQYNSTYRVVSVLTVLHQDWLNGKEYKCKVSNKAL PAPIEKTISKAKGQPREPQVYVLPPSREEMTKNQVSLLCLVKGFYPSD IAVEWESNGQPENNYLTWPPVLDSDGSFFLYSKLTVDKSRWQQGNVFS CSVMHEALHNHYTQKSLSLSPGK (SEQ ID NO: 882) |
| KL2B30_HL | Amino Acid Sequence | MAWVWTLLFLMAAAQSIQAVQLQESGPGLVKPSETLSLTCTVSGGSI SSYYWSWIRQPPGKGLEWIGYIYYSGSTNYNPSLKSRVTISVDTSKNQ FSLKLSSVTAADTAVYYCAGTTIFGVVTPNFYYGMDVWGQGTTVTVSS GGSEGKSSGSGSESKSTGGSDIQMTQSPSFLSASVGDRVTITCRASQG ISSYLAWYQQKPGKAPKFLIYAASTLQSGVPSRFSGSGSGTEFTLTIS SLQPEDFATYYCQQLNSYPLTFGGGTKVEIK (SEQ ID NO: 883) |
| KL2B30_LH | Amino Acid Sequence | MAWVWTLLFLMAAAQSIQADIQMTQSPSFLSASVGDRVTITCRASQGI SSYLAWYQQKPGKAPKFLIYAASTLQSGVPSRFSGSGSGTEFTLTISS LQPEDFATYYCQQLNSYPLTFGGGTKVEIKGGSEGKSSGSGSESKSTG GSQVQLQESGPGLVKPSETLSLTCTVSGGSISSYYWSWIRQPPGKGLE WIGYIYYSGSTNYNPSLKSRVTISVDTSKNQFSLKLSSVTAADTAVYY CAGTTIFGVVTPNFYYGMDVWGQGTTVTVSS (SEQ ID NO: 884) |
| | linker | GGSEGKSSGSGSESKSTGGS (SEQ ID NO: 690) |
| KL2B30 | Heavy Chain/ Nucleotide Sequence | CAGGTGCAGCTGCAGGAGTCGGGCCCAGGACTGGTGAAGCCTTCGGAG ACCCTGTCCCTCACCTGCACTGTCTCTGGTGGCTCCATCAGTAGTTAC TACTGGAGCTGGATCCGGCAGCCCCCAGGGAAGGGACTGGAGTGGATT GGATATATCTATTACAGTGGGAGCACCAACTACAACCCCTCCCTCAAG AGTCGAGTCACCATATCAGTAGACACGTCCAAGAACCAGTTCTCCCTG AAGCTGAGCTCTGTGACCGCTGCGGACACGGCCGTGTATTACTGTGCG GGGACTACGATTTTTGGAGTGGTTACCCCCAACTTCTACTACGGTATG GACGTCTGGGGCCAAGGGACCACGGTCACCGTCTCCTCAGCTTCCACC AAGGGCCCATCCGTCTTCCCCCTGGCGCCCTGCTCCAGGAGCACCTCC GAGAGCACAGCCGCCCTGGGCTGCCTGGTCAAGGACTACTTCCCCGAA CCGGTGACGGTGTCGTGGAACTCAGGCGCCCTGACCAGCGGCGTGCAC ACCTTCCCGGCTGTCCTACAGTCCTCAGGACTCTACTCCCTCAGCAGC GTGGTGACCGTGCCCTCCAGCAGCTTGGGCACGAAAACCTACACTTGC AACGTAGATCACAAGCCCAGCAACACCAAGGTGGACAAGAGAGTTGAG TCCAAATATGGTCCCCCATGCCCACCATGCCCAGCACCTGAGGCCGCC GGGGGACCATCAGTCTTCCTGTTCCCCCCAAAACCCAAGGACACTCTC ATGATCTCCCGGACCCCTGAGGTCACGTGCGTGGTGGTGGACGTGAGC CAGGAAGACCCCGAGGTCCAGTTCAACTGGTACGTGGATGGCGTGGAG GTGCATAATGCCAAGACAAAGCCGCGGGAGGAGCAGTTCAACAGCACG TACCGTGTGGTCAGCGTCCTCACCGTCCTGCACCAGGACTGGCTGAAC GGCAAGGAGTACAAGTGCAAGGTCTCCAACAAAGGCCTCCCGTCCTCC ATCGAGAAAACCATCTCCAAAGCCAAAGGGCAGCCCCGAGAGCCACAG GTGTACACCCTGCCCCCATCCCAGGAGGAGATGACCAAGAACCAGGTC AGCCTGACCTGCCTGGTCAAAGGCTTCTACCCCAGCGACATCGCCGTG GAGTGGGAGAGCAATGGGCAGCCGGAGAACAACTACAAGACCACGCCT CCCGTGCTGGACTCCGACGGCTCCTTCTTCCTCTACAGCAGGCTAACC |

TABLE 46-continued

Amino acid and nucleotide sequences of KL2B30 antibodies and variants

| Antibody Name | Region/ Description | Complete Sequence (SEQ ID NO) |
|---|---|---|
| | | GTGGACAAGAGCAGATGGCAGGAGGGGAATGTCTTCTCATGCTCCGTG ATGCATGAGGCTCTGCACAACCACTACACAGAAGAGCCTCTCCCTG TCTCTGGGTAAA (SEQ ID NO: 885) |
| KL2B30 | Light Chain/ Nucleotide Sequence | GACATCCAGATGACCCAGTCTCCTTCCTTCCTGTCTGCATCTGTAGGA GACAGAGTCACCATCACTTGCCGGGCCAGTCAGGGCATTAGCAGTTAT TTAGCCTGGTATCAGCAAAAACCAGGGAAAGCCCCTAAGTTCCTGATC TATGCTGCATCCACTTTGCAAAGTGGGGTCCCATCAAGGTTCAGCGGC AGTGGATCTGGGACAGAATTCACTCTCACAATCAGCAGCCTGCAGCCT GAAGATTTTGCAACTTATTACTGTCAACAGCTTAATAGTTACCCTCTC ACTTTCGGCGGAGGGACCAAGGTGGAAATCAAACGTACGGTGGCTGCA CCATCTGTCTTCATCTTCCCGCCATCTGATGAGCAGTTGAAATCTGGA ACTGCCTCTGTTGTGTGCCTGCTGAATAACTTCTATCCCAGAGAGGCC AAAGTACAGTGGAAGGTGGATAACGCCCTCCAATCGGGTAACTCCCAG GAGAGTGTCACAGAGCAGGACAGCAAGGACAGCACCTACAGCCTCAGC AGCACCCTGACGCTGAGCAAAGCAGACTACGAGAAACACAAAGTCTAC GCCTGCGAAGTCACCCATCAGGGCCTGAGCTCGCCCGTCACAAAGAGC TTCAACAGGGGAGAGTGT (SEQ ID NO: 886) |

Anti-KLK2 antibodies and their variants with modified constant regions (i.e., with L234A/L235A/D265S mutations, low fucosylated and/or with K248E and T437R (RE) mutations) were generated and tested for their ability to mediate tumor cell killing via ADCC in the Vertebral-Cancer of the Prostate (VcaP) cell line, a cell line established from prostate cancer tissue, and these antibodies are summarized in the Table 47 below.

TABLE 47

Anti-KLK2 antibodies and their variants

| Antibody | Description | EC50 (M) | 95% CI (M) |
|---|---|---|---|
| KL2B870 (KL2B30 in hIgG1-RE) | IgG1, K248E, T437R (RE) | $1.001 \times 10^{-9}$ | $5.149 \times 10^{-10}$ to $2.221 \times 10^{-9}$ |
| KL2B871 (KL2B30 in hIgG1-AAS) | L234A, L235A, D265S | | |
| KL2B872 (KL2B30 in hIgG1) | Wildtype IgG1 | | |
| KL2B872.CLF | IgG1, low fucosylation | $4.118 \times 10^{-10}$ | $1.747 \times 10^{-10}$ to $8.869 \times 10^{-10}$ |
| KL2B870.CLF | IgG1, K248E, T437R (RE), | $3.542 \times 10^{-10}$ | $1.789 \times 10^{10}$ to $6.006 \times 10^{-10}$ |

TABLE 47-continued

Anti-KLK2 antibodies and their variants

| Antibody | Description | EC50 (M) | 95% CI (M) |
|---|---|---|---|
| | low fucosylation | | |

The parental antibody KL2B30 was modified in its Fc region to introduce the L234A, L235A and D265S mutations (AAS mutations), which resulted in an Fc region that does not bind Fc receptors. The resulting KL2B871 was generated as a negative control. The KL2B30 antibody was modified in its Fc region to introduce the K248E and T437R mutations (RE mutations), and the resulting antibody is KL2B870. KL2B870 and KL2B872 antibodies were expressed in fucosylation-deficient cells to produce antibodies with low fucosylation (e.g., expressing these antibodies in fucosylation-deficient Chinese Hamster Ovary cells produces antibodies with less than 10% fucosylation), which were designated as KL2B870.CLF and KL2B872.CLF, respectively (see Table 47).

The VH and VL amino acid sequences of KL2B870, KL2B871 and KL2B872 antibodies are summarized in Table 48 below.

TABLE 48

VH and VL amino acid sequences of Anti-KLK2 antibodies

| Antibody Name | VH/VL | Complete Sequence (SEQ ID NO) |
|---|---|---|
| KL2B870 | VH | QVQLQESGPGLVKPSETLSLTCTVSGGSISSYYWSWIRQPPGKGLEWIGYI YYSGSTNYNPSLKSRVTISVDTSKNQFSLKLSSVTAADTAVYYCAGTTIFG VVTPNFYYGMDVWGQGTTVTVSS (SEQ ID NO: 887) |
| KL2B870 | VL | DIQMTQSPSFLSASVGDRVTITCRASQGISSYLAWYQQKPGKAPKFLIYAA STLQSGVPSRFSGSGSGTEFTLTISSLQPEDFATYYCQQLNSYPLTFGGGT KVEIK (SEQ ID NO: 888) |
| KL2B871 | VH | QVQLQESGPGLVKPSETLSLTCTVSGGSISSYYWSWIRQPPGKGLEWIGYI YYSGSTNYNPSLKSRVTISVDTSKNQFSLKLSSVTAADTAVYYCAGTTIFG VVTPNFYYGMDVWGQGTTVTVSS (SEQ ID NO: 887) |

TABLE 48-continued

VH and VL amino acid sequences of Anti-KLK2 antibodies

| Antibody Name | VH/VL | Complete Sequence (SEQ ID NO) |
|---|---|---|
| KL2B871 | VL | DIQMTQSPSFLSASVGDRVTITCRASQGISSYLAWYQQKPGKAPKFLIYAA STLQSGVPSRFSGSGSGTEFTLTISSLQPEDFATYYCQQLNSYPLTFGGGT KVEIK (SEQ ID NO: 888) |
| KL2B872 | VH | QVQLQESGPGLVKPSETLSLTCTVSGGSISSYYWSWIRQPPGKGLEWIGYI YYSGSTNYNPSLKSRVTISVDTSKNQFSLKLSSVTAADTAVYYCAGTTIFG VVTPNFYYGMDVWGQGTTVTVSS (SEQ ID NO: 887) |
| KL2B872 | VL | DIQMTQSPSFLSASVGDRVTITCRASQGISSYLAWYQQKPGKAPKFLIYAA STLQSGVPSRFSGSGSGTEFTLTISSLQPEDFATYYCQQLNSYPLTFGGGT KVEIK (SEQ ID NO: 888) |

The VH and VL nucleotide sequences of KL2B870, KL2B871 and KL2B872 antibodies are summarized in Table 49 below.

TABLE 49

VH and VL nucleotide sequences of Anti-KLK2 antibodies

| Antibody Name | VH/VL | Complete Sequence (SEQ ID NO) |
|---|---|---|
| KL2B870 | VH | CAGGTGCAGCTGCAGGAGTCGGGCCCAGGACTGGTGAAGCCTTCGGAGACCCTGT CCCTCACCTGCACTGTCTCTGGTGGCTCCATCAGTAGTTACTACTGGAGCTGGAT CCGGCAGCCCCCAGGGAAGGGACTGGAGTGGATTGGATATATCTATTACAGTGGG AGCACCAACTACAACCCCTCCCTCAAGAGTCGAGTCACCATATCAGTAGACACGT CCAAGAACCAGTTCTCCCTGAAGCTGAGCTCTGTGACCGCTGCGGACACGGCCGT GTATTACTGTGCGGGGACTACGATTTTTGGAGTGGTTACCCCCAACTTCTACTAC GGTATGGACGTCTGGGGCCAAGGGACCACGGTCACCGTCTCCTCA (SEQ ID NO: 889) |
| KL2B870 | VL | GACATCCAGATGACCCAGTCTCCTTCCTTCCTGTCTGCATCTGTAGGAGACAGAG TCACCATCACTTGCCGGGCCAGTCAGGGCATTAGCAGTTATTTAGCCTGGTATCA GCAAAAACCAGGGAAAGCCCCTAAGTTCCTGATCTATGCTGCATCCACTTTGCAA AGTGGGGTCCCATCAAGGTTCAGCGGCAGTGGATCTGGGACAGAATTCACTCTCA CAATCAGCAGCCTGCAGCCTGAAGATTTTGCAACTTATTACTGTCAACAGCTTAA TAGTTACCCTCTCACTTTCGGCGGAGGGACCAAGGTGGAAATCAAA (SEQ ID NO: 890) |
| KL2B871 | VH | CAGGTGCAGCTGCAGGAGTCGGGCCCAGGACTGGTGAAGCCTTCGGAGACCCTGT CCCTCACCTGCACTGTCTCTGGTGGCTCCATCAGTAGTTACTACTGGAGCTGGAT CCGGCAGCCCCCAGGGAAGGGACTGGAGTGGATTGGATATATCTATTACAGTGGG AGCACCAACTACAACCCCTCCCTCAAGAGTCGAGTCACCATATCAGTAGACACGT CCAAGAACCAGTTCTCCCTGAAGCTGAGCTCTGTGACCGCTGCGGACACGGCCGT GTATTACTGTGCGGGGACTACGATTTTTGGAGTGGTTACCCCCAACTTCTACTAC GGTATGGACGTCTGGGGCCAAGGGACCACGGTCACCGTCTCCTCA (SEQ ID NO: 889) |
| KL2B871 | VL | GACATCCAGATGACCCAGTCTCCTTCCTTCCTGTCTGCATCTGTAGGAGACAGAG TCACCATCACTTGCCGGGCCAGTCAGGGCATTAGCAGTTATTTAGCCTGGTATCA GCAAAAACCAGGGAAAGCCCCTAAGTTCCTGATCTATGCTGCATCCACTTTGCAA AGTGGGGTCCCATCAAGGTTCAGCGGCAGTGGATCTGGGACAGAATTCACTCTCA CAATCAGCAGCCTGCAGCCTGAAGATTTTGCAACTTATTACTGTCAACAGCTTAA TAGTTACCCTCTCACTTTCGGCGGAGGGACCAAGGTGGAAATCAAA (SEQ ID NO: 890) |
| KL2B872 | VH | CAGGTGCAGCTGCAGGAGTCGGGCCCAGGACTGGTGAAGCCTTCGGAGACCCTGT CCCTCACCTGCACTGTCTCTGGTGGCTCCATCAGTAGTTACTACTGGAGCTGGAT CCGGCAGCCCCCAGGGAAGGGACTGGAGTGGATTGGATATATCTATTACAGTGGG AGCACCAACTACAACCCCTCCCTCAAGAGTCGAGTCACCATATCAGTAGACACGT CCAAGAACCAGTTCTCCCTGAAGCTGAGCTCTGTGACCGCTGCGGACACGGCCGT GTATTACTGTGCGGGGACTACGATTTTTGGAGTGGTTACCCCCAACTTCTACTAC GGTATGGACGTCTGGGGCCAAGGGACCACGGTCACCGTCTCCTCA (SEQ ID NO: 889) |
| KL2B872 | VL | GACATCCAGATGACCCAGTCTCCTTCCTTCCTGTCTGCATCTGTAGGAGACAGAG TCACCATCACTTGCCGGGCCAGTCAGGGCATTAGCAGTTATTTAGCCTGGTATCA GCAAAAACCAGGGAAAGCCCCTAAGTTCCTGATCTATGCTGCATCCACTTTGCAA AGTGGGGTCCCATCAAGGTTCAGCGGCAGTGGATCTGGGACAGAATTCACTCTCA CAATCAGCAGCCTGCAGCCTGAAGATTTTGCAACTTATTACTGTCAACAGCTTAA |

TABLE 49-continued

VH and VL nucleotide sequences of Anti-KLK2 antibodies

| Antibody Name | VH/ VL | Complete Sequence (SEQ ID NO) |
|---|---|---|
| | | TAGTTACCCTCTCACTTTCGGCGGAGGGACCAAGGTGGAAATCAAA (SEQ ID NO: 890) |

The complete amino acid sequences of the light chains and heavy chains of KL2B870, KL2B871 and KL2B872 antibodies are summarized in Table 50 below.

TABLE 50

Heavy chain and light chain amino acid sequences of Anti-KLK2 antibodies

| Antibody Name | Region | Complete Sequence (SEQ ID NO) |
|---|---|---|
| KL2B870 | Heavy chain | QVQLQESGPGLVKPSETLSLTCTVSGGSISSYYWSWIRQPPGKGLEWIGYIYYSG STNYNPSLKSRVTISVDTSKNQFSLKLSSVTAADTAVYYCAGTTIFGVVTPNFYY GMDVWGQGTTVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVD KKVEPKSCDKTHTCPPCPAPELLGGPSVFLFPPKPEDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYRQKSLSLSPG (SEQ ID NO: 891) |
| KL2B870 | Light chain | DIQMTQSPSFLSASVGDRVTITCRASQGISSYLAWYQQKPGKAPKFLIYAASTLQ SGVPSRFSGSGSGTEFTLTISSLQPEDFATYYCQQLNSYPLTEGGGTKVEIKRTV AAPSVFIFPPSDEQLKSGTASVVCLLNNFYPREAKVQWKVDNALQSGNSQESVTE QDSKDSTYSLSSTLTLSKADYEKHKVYACEVTHQGLSSPVTKSFNRGEC (SEQ ID NO: 892) |
| KL2B871 | Heavy chain | QVQLQESGPGLVKPSETLSLTCTVSGGSISSYYWSWIRQPPGKGLEWIGYIYYSG STNYNPSLKSRVTISVDTSKNQFSLKLSSVTAADTAVYYCAGTTIFGVVTPNFYY GMDVWGQGTTVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVD KKVEPKSCDKTHTCPPCPAPEAAGGPSVFLFPPKPKDTLMISRTPEVTCVVVSVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPG (SEQ ID NO: 893) |
| KL2B871 | Light chain | DIQMTQSPSFLSASVGDRVTITCRASQGISSYLAWYQQKPGKAPKFLIYAASTLQ SGVPSRFSGSGSGTEFTLTISSLQPEDFATYYCQQLNSYPLTFGGGTKVEIKRTV AAPSVFIFPPSDEQLKSGTASVVCLLNNFYPREAKVQWKVDNALQSGNSQESVTE QDSKDSTYSLSSTLTLSKADYEKHKVYACEVTHQGLSSPVTKSFNRGEC (SEQ ID NO: 892) |
| KL2B872 | Heavy chain | QVQLQESGPGLVKPSETLSLTCTVSGGSISSYYWSWIRQPPGKGLEWIGYIYYSG STNYNPSLKSRVTISVDTSKNQFSLKLSSVTAADTAVYYCAGTTIFGVVTPNFYY GMDVWGQGTTVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNTKVD KKVEPKSCDKTHTCPPCPAPELLGGPSVFLFPPKPKDTLMISRTPEVTCVVVDVS HEDPEVKFNWYVDGVEVHNAKTKPREEQYNSTYRVVSVLTVLHQDWLNGKEYKCK VSNKALPAPIEKTISKAKGQPREPQVYTLPPSREEMTKNQVSLTCLVKGFYPSDI AVEWESNGQPENNYKTTPPVLDSDGSFFLYSKLTVDKSRWQQGNVFSCSVMHEAL HNHYTQKSLSLSPG (SEQ ID NO: 894) |
| KL2B872 | Light chain | DIQMTQSPSFLSASVGDRVTITCRASQGISSYLAWYQQKPGKAPKFLIYAASTLQ SGVPSRFSGSGSGTEFTLTISSLQPEDFATYYCQQLNSYPLTFGGGTKVEIKRTV AAPSVFIFPPSDEQLKSGTASVVCLLNNFYPREAKVQWKVDNALQSGNSQESVTE QDSKDSTYSLSSTLTLSKADYEKHKVYACEVTHQGLSSPVTKSFNRGEC (SEQ ID NO: 892) |

The complete nucleotide sequences of the light chains and heavy chains of KL2B870, KL2B871 and KL2B872 antibodies are summarized in Table 51 below.

TABLE 51

Heavy chain and light chain nucleotide sequences of Anti-KLK2 antibodies

| Antibody Name | Region | Complete Sequence (SEQ ID NO) |
|---|---|---|
| KL2B870 | Heavy chain | CAAGTACAGCTTCAGGAGTCAGGCCCCGGCTTGGTGAAACCAAGTGAGACCCTCTCCCTCACCTGCACAGTTAGCGGCGGTTCAATATCATCATACTATTGGTCTTGGATTCGTCAGCCACCTGGCAAAGGTCTCGAGTGGATTGGCTATATATATTATTCAGGGTCAACAAATTACAATCCTTCACTCAAGTCTCGCGTCACCATTAGCGTAGACACCAGCAAAAATCAGTTTTCCCTCAAGCTCTCATCAGTGACCGCCGCAGATACCGCTGTATATTACTGCGCTGGTACCACAATATTTGGAGTGGTTACCCCTAATTTCTATTATGGAATGGACGTATGGGCCAGGGGACCACCGTGACAGTTTCCTCTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGTCCACCGTGCCCAGCACCTGAACTGCTGGGGGGACCGTCAGTCTTCCTCTTCCCCCCAAAACCCGAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTACAGCAAGCTCACCGTGGACAAGTCTAGATGGCAGCAGGGGAACGTCTTCTCATGCTCCGTGATGCATGAGGCTCTGCACAACCACTACCGCCAGAAGAGCCTCTCCCTGTCTCCGGGT (SEQ ID NO: 895) |
| KL2B870 | Light chain | GATATACAAATGACCCAATCTCCTTCCTTTTTGTCAGCAAGCGTTGGTGACCGCGTCACCATAACTTGTAGGGCTAGCCAGGGTATTTCTAGTTATCTGGCTTGGTATCAGCAAAAACCTGGCAAAGCCCCTAAATTTCTTATCTACGCCGCAAGCACTCTGCAATCAGGCGTGCCCAGCAGATTCTCAGGCTCTGGTTCAGGCACAGAGTTTACTCTGACTATATCCAGCCTGCAACCTGAAGACTTTGCTACATACTATTGTCAGCAACTCAACAGTTACCCCCTTACTTTCGGGGGCGGCACTAAGGTGGAAATAAAGCGTACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGT (SEQ ID NO: 896) |
| KL2B871 | Heavy chain | CAAGTACAGCTTCAGGAGTCAGGCCCCGGCTTGGTGAAACCAAGTGAGACCCTCTCCCTCACCTGCACAGTTAGCGGCGGTTCAATATCATCATACTATTGGTCTTGGATTCGTCAGCCACCTGGCAAAGGTCTCGAGTGGATTGGCTATATATATTATTCAGGGTCAACAAATTACAATCCTTCACTCAAGTCTCGCGTCACCATTAGCGTAGACACCAGCAAAAATCAGTTTTCCCTCAAGCTCTCATCAGTGACCGCCGCAGATACCGCTGTATATTACTGCGCTGGTACCACAATATTTGGAGTGGTTACCCCTAATTTCTATTATGGAATGGACGTATGGGCCAGGGGACCACCGTGACAGTTTCCTCTGCCTCCACCAAGGGCCCATCGGTCTTCCCCCTGGCACCCTCCTCCAAGAGCACCTCTGGGGGCACAGCGGCCCTGGGCTGCCTGGTCAAGGACTACTTCCCCGAACCGGTGACGGTGTCGTGGAACTCAGGCGCCCTGACCAGCGGCGTGCACACCTTCCCGGCTGTCCTACAGTCCTCAGGACTCTACTCCCTCAGCAGCGTGGTGACCGTGCCCTCCAGCAGCTTGGGCACCCAGACCTACATCTGCAACGTGAATCACAAGCCCAGCAACACCAAGGTGGACAAGAAAGTTGAGCCCAAATCTTGTGACAAAACTCACACATGTCCACCGTGCCCAGCACCTGAAGCAGCAGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTACAGCAAGCTCACCGTGGACAAGTCTAGATGGCAGCAGGGGAACGTCTTCTCATGCTCCGTGATGCATGAGGCTCTGCACAACCACTACACGCAGAAGAGCCTCTCCCTGTCTCCGGGT (SEQ ID NO: 897) |

TABLE 51-continued

Heavy chain and light chain nucleotide sequences of Anti-KLK2 antibodies

| Antibody Name | Region | Complete Sequence (SEQ ID NO) |
|---|---|---|
| KL2B871 | Light chain | GATATACAAATGACCCAATCTCCTTCCTTTTTGTCAGCAAGCGTTGGTGACCG CGTCACCATAACTTGTAGGGCTAGCCAGGGTATTTCTAGTTATCTGGCTTGGT ATCAGCAAAAACCTGGCAAAGCCCCTAAATTTCTTATCTACGCCGCAAGCACT CTGCAATCAGGCGTGCCCAGCAGATTCTCAGGCTCTGGTTCAGGCACAGAGTT TACTCTGACTATATCCAGCCTGCAACCTGAAGACTTTGCTACATACTATTGTC AGCAACTCAACAGTTACCCCCTTACTTTCGGGGGCGGCACTAAGGTGGAAATA AAGCGTACGGTGGCTGCACCATCTGTCTTCATCTTCCCGCCATCTGATGAGCA GTTGAAATCTGGAACTGCCTCTGTTGTGTGCCTGCTGAATAACTTCTATCCCA GAGAGGCCAAAGTACAGTGGAAGGTGGATAACGCCCTCCAATCGGGTAACTCC CAGGAGAGTGTCACAGAGCAGGACAGCAAGGACAGCACCTACAGCCTCAGCAG CACCCTGACGCTGAGCAAAGCAGACTACGAGAAACACAAAGTCTACGCCTGCG AAGTCACCCATCAGGGCCTGAGCTCGCCCGTCACAAAGAGCTTCAACAGGGGA GAGTGT (SEQ ID NO: 896) |
| KL2B872 | Heavy chain | CAAGTACAGCTTCAGGAGTCAGGCCCCGGCTTGGTGAAACCAAGTGAGACCCT CTCCCTCACCTGCACAGTTAGCGGCGGTTCAATATCATCATACTATTGGTCTT GGATTCGTCAGCCACCTGGCAAAGGTCTCGAGTGGATTGGCTATATATATTAT TCAGGGTCAACAAATTACAATCCTTCACTCAAGTCTCGCGTCACCATTAGCGT AGACACCAGCAAAAATCAGTTTTCCCTCAAGCTCTCATCAGTGACCGCCGCAG ATACCGCTGTATATTACTGCGCTGGTACCACAATATTTGGAGTGGTTACCCCT AATTTCTATTATGGAATGGACGTATGGGGCCAGGGGACCACCGTGACAGTTTC CTCTGCCTCCACCAAGGGCCCATCGGTCTTCCCCCTGGCACCCTCCTCCAAGA GCACCTCTGGGGGCACAGCGGCCCTGGGCTGCCTGGTCAAGGACTACTTCCCC GAACCGGTGACGGTGTCGTGGAACTCAGGCGCCCTGACCAGCGGCGTGCACAC CTTCCCGGCTGTCCTACAGTCCTCAGGACTCTACTCCCTCAGCAGCGTGGTGA CCGTGCCCTCCAGCAGCTTGGGCACCCAGACCTACATCTGCAACGTGAATCAC AAGCCCAGCAACACCAAGGTGGACAAGAAAGTTGAGCCCAAATCTTGTGACAA AACTCACACATGTCCACCGTGCCCAGCACCTGAACTGCTGGGGGGACCGTCAG TCTTCCTCTTCCCCCCAAAACCCAAGGACACCCTCATGATCTCCCGGACCCCT GAGGTCACATGCGTGGTGGTGGACGTGAGCCACGAAGACCCTGAGGTCAAGTT CAACTGGTACGTGGACGGCGTGGAGGTGCATAATGCCAAGACAAAGCCGCGGG AGGAGCAGTACAACAGCACGTACCGTGTGGTCAGCGTCCTCACCGTCCTGCAC CAGGACTGGCTGAATGGCAAGGAGTACAAGTGCAAGGTCTCCAACAAAGCCCT CCCAGCCCCCATCGAGAAAACCATCTCCAAAGCCAAAGGGCAGCCCCGAGAAC CACAGGTGTACACCCTGCCCCCATCCCGGGAGGAGATGACCAAGAACCAGGTC AGCCTGACCTGCCTGGTCAAAGGCTTCTATCCCAGCGACATCGCCGTGGAGTG GGAGAGCAATGGGCAGCCGGAGAACAACTACAAGACCACGCCTCCCGTGCTGG ACTCCGACGGCTCCTTCTTCCTCTACAGCAAGCTCACCGTGGACAAGTCTAGA TGGCAGCAGGGGAACGTCTTCTCATGCTCCGTGATGCATGAGGCTCTGCACAA CCACTACACGCAGAAGAGCCTCTCCCTGTCTCCGGGT (SEQ ID NO: 898) |
| KL2B872 | Light chain | GATATACAAATGACCCAATCTCCTTCCTTTTTGTCAGCAAGCGTTGGTGACCG CGTCACCATAACTTGTAGGGCTAGCCAGGGTATTTCTAGTTATCTGGCTTGGT ATCAGCAAAAACCTGGCAAAGCCCCTAAATTTCTTATCTACGCCGCAAGCACT CTGCAATCAGGCGTGCCCAGCAGATTCTCAGGCTCTGGTTCAGGCACAGAGTT TACTCTGACTATATCCAGCCTGCAACCTGAAGACTTTGCTACATACTATTGTC AGCAACTCAACAGTTACCCCCTTACTTTCGGGGGCGGCACTAAGGTGGAAATA AAGCGTACGGTGGCTGCACCATCTGTCTTCATCTTCCCGCCATCTGATGAGCA GTTGAAATCTGGAACTGCCTCTGTTGTGTGCCTGCTGAATAACTTCTATCCCA GAGAGGCCAAAGTACAGTGGAAGGTGGATAACGCCCTCCAATCGGGTAACTCC CAGGAGAGTGTCACAGAGCAGGACAGCAAGGACAGCACCTACAGCCTCAGCAG CACCCTGACGCTGAGCAAAGCAGACTACGAGAAACACAAAGTCTACGCCTGCG AAGTCACCCATCAGGGCCTGAGCTCGCCCGTCACAAAGAGCTTCAACAGGGGA GAGTGT (SEQ ID NO: 896) |

Example 7.2: Preparation of Anti-KLK2/Anti-Vβ17 Bispecific Antibodies

The anti-KLK2/anti-Vβ17 antibody is generated by co-expression of the anti-Vb17 knob heavy chain and light chain (LC) with the anti-KLK2 heavy chain B. The anti-Vb17 with humanized variable region further modified by mutation of N33S in the light chain CDR1 variable domain to remove a deamidation risk is used to generate the bispecific antibodies.

The designed heavy chain molecules are synthesized into gblocks (IDT; Coralville, IA) containing 15 bp overlaps at the 5' and 3' ends for ligation independent cloning using InFusion method (ClonTech). All light chain constructs are inserted into pLonza vector containing the BswiI and HindIII restriction sites for in-frame ligation to the human kappa constant domain. Murine IgH signal peptides are encoded to allow for efficient secretion of mAbs into culture supernatant. All gblocks are reconstituted in sterile water and incubated at 50° C. for 10 minutes as per manufacturer protocol. pLonza vector (Lonza; Basel, Switzerland) is linearized using EcoRI and HindIII followed by gel extraction and cleanup. A 2:1 mass ratio of linearized vector to insert is used followed by heat pulse at 50° C. for 15 minutes. The infusion reactions are transformed into Stellar competent cells (ClonTech) and resultant colonies are scaled for miniprep. All constructs are sequence verified and scaled up using Endotoxin free maxi preparation kits (Qiagen; Hilden, Germany).

The VH amino acid sequence of the Vβ17 antibody used is SEQ ID NO: 21. The VL amino acid sequences of the Vβ17 antibody used is SEQ ID NO: 23 and SEQ ID NO: 677. The VH nucleotide sequences of the anti-Vβ17 antibodies is SEQ ID NOs: 713 or 715. The VL nucleotide sequences of the anti-Vβ17 antibodies is SEQ NOs: 714 or 716.

Example 7.3: Characterization of Anti-KLK2/Anti-Vβ17 Bispecific Antibodies

Bispecific KLK2×Vβ17 mediated cytotoxicity against KLK2+ target cell lines in pan-T cells. KLK2+ cell lines are used at two different Effector to Target ratios (E:T):10:1 and 5:1. On day 0 of the experiment, xCelligence plates are blanked with 50 μl of growth media and are then seeded with 20,000 cells per well. These plates are then incubated on the xCelligence machine overnight. On day 1 of the experiment, one PAN-T donor is used to prepare the different E:T ratios. 50 μl of 4×106/ml PAN-T cells (200,000 cells) is added into each well. Then 50 μl of the bispecific anti-KLK2×Vβ17 antibodies are added to the appropriate wells for each plate. The final bispecific antibody concentrations are 150 nM, 50 nM, 16.7 nM, 5.5 nM, 1.8 nM and 0 nM, respectively. The plates are then placed in the xCelligence machine and impedance is recorded every 15 minutes for 120 hours. The percent cytolysis is calculated on the RTCA software.

Bispecific anti-KLK2×Vβ17 mediated cytotoxicity against KLK2+ target cell lines in PBMCs. To test the efficacy of anti-KLK2×VB17 antibodies in cytotoxic activity against KLK2 expressing target cells, the time course analysis of tumor cell lysis at various effector to target (ET) ratios is carried out. KLK2 expressing cell line stably expressing the nuclear restricted NucLight Red (NLR) protein is used in the cytotoxicity assay. On the day of the assay, the cells are collected into a 50 ml falcon tube and spun down at 1300 rpm for 5 min. The cell pellet is then resuspended in modified RPMI 1640 media+10% FBS (complete media) and cell count is estimated using trypan blue live dead marker by a hemocytometer. The cells are then plated onto a collagen coated 96-well plate at 10,000 cells/well/90W of complete media. The cells are evenly distributed by gentle agitation and allowed to settle for 1 hour in a 5% $CO_2$ incubator.

Vials of PBMCs frozen from healthy donors (Clinigene) are rapidly thawed in a 37° C. water bath, transferred to a 15 mL conical tube, and washed once with 10 mL complete medium. The cells are stained with anti-human Vβ17 antibody and analyzed by flow cytometer to determine the Vβ17% within PBMCs. The PBMCs from each donor are counted using trypan blue live dead marker by a hemocytometer. Appropriate numbers of PBMCs required to get effector to target (ET) ratios of 0.5:1, 0.25:1 and 0.125:1 (Vβ17:target cell) are added to the plated target cells in 90 μl complete media. The test antibodies are then prepared as 10× stocks in complete media and 3-fold serial dilutions are prepared. The serially diluted test antibodies are added to the PBMC-tumor coculture at 20 μl/well until the final concentration of antibody became 1×. Wells with no antibody (NBS) are used as control for the basal cytotoxicity. The plates are placed in an IncuCyte S3® (Essen BioScience) at 37° C. with 5% $CO_2$ for 120 hours. An increase in red signal corresponds to target cell proliferation and a decrease in signal corresponds to target cell death. % lysis is calculated as ={100−(red signal intensity at a specific time point with Antibody/red signal intensity at that time point in NBS wells)*100}.

Plates are scanned for up to 120 hours in an IncuCyte S3® (Essen BioScience) in a 37° C. with 5% $CO_2$ incubator. Percent lysis is calculated as the difference between the red signal intensity at a specific time point with antibody divided by the red signal intensity at that time point in NBS wells.

Proliferation of Vβ17+ T cells in response to KLK2× Vβ17 antibody in whole PBMC cytotoxicity assay. Vβ17 T cells constitute approximately 2-5% of T cells in human PBMCs. To test if the binding of the bispecific antibody induces proliferation and expansion of the Vβ17 T cells, percentage of Vβ17 T cells undergoing proliferation and the total number of Vβ17 T cells in the culture are determined. KLK2+ cell line stably expressing the nuclear restricted NucLight Red (NLR) protein is used in the cytotoxicity assay. On the day of the assay, the cells are collected into a 50 ml falcon tube and spun down at 1300 rpm for 5 min. The cell pellet is then resuspended in 1 ml modified RPMI 1640 media+10% FBS (complete media) and cell count is estimated using trypan blue live dead marker using a hemocytometer. The cells are then plated onto a collagen coated plate 96 well plate at 10,000 cells/well/90 μl of complete media. The cells are evenly distributed by gentle agitation and allowed to settle for 1 hour in a 5% $CO_2$ incubator.

Vials of PBMCs frozen from healthy donors (Clinigene) are rapidly thawed in a 37° C. water bath, transferred to a 15 mL conical tube, and washed once with 10 mL complete medium. The cells are stained with anti-human Vβ17 antibody and analyzed by flow cytometer to determine the Vβ17% within PBMCs. PBMCs are stained Cell Trace Violet dye (C34571, Thermo Fisher Scientific). PBMCs from each donor are counted using trypan blue live dead marker using a hemocytometer. Appropriate number of PBMCs required to get effector to target (ET) ratio of 0.5:1 (VB17:target cell) are added to the plated target cells in 90 μl complete media. The test antibodies are prepared as 10× stocks in complete media and 3-fold serial dilutions are prepared from the starting concentration for a total of 3 dilution points. The serially diluted test antibodies are added to the PBMC-tumor coculture at 20 μl/well so that the final concentration of antibody became 1×. Wells with no antibody (NBS) are used as control for the basal cytotoxicity. The plates are incubated in a 5% $CO_2$ incubator for the indicated time periods.

At the end of the incubation period the cells suspension is transferred to a v-Bottom plate and is spun down at 1500 rpm for 5 min. The pellet is resuspended in 100 μl of DPBS. 10 μl of the cell suspension is taken for determining the total cell count at each antibody concentration using Trypan blue with a hemocytometer. The rest of the cell suspension is subjected to LIVE/DEAD™ Fixable Near-IR Dead Cell Stain Kit (L10119) and incubated for 20 min on ice. The viability stain is inactivated using FACS buffer and is spun down at 1500 rpm for 5 min. Cells are stained with BD Fc block (564220, BD Pharmingen) for 10 min followed by staining with Vβ17-PE antibody and αβ BV510 antibody (306734, Biolegend).

Example 8—Multispecific Antibodies that Bind Vβ17 and BCMA

Example 8.1: Anti-Vβ17 and Anti-BCMA Antibodies

Figure 26A:
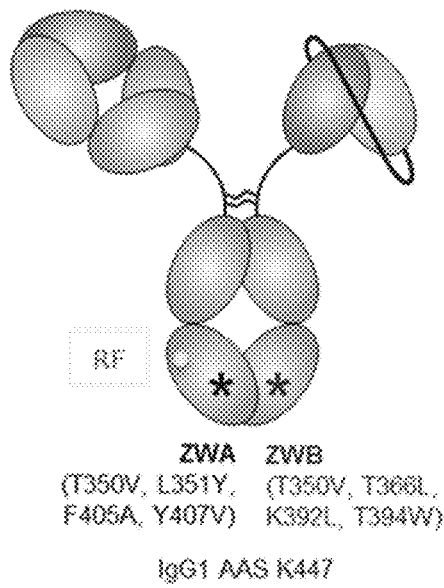
FIGS. 26A-26B illustrate bispecific antibodies with one Vβ17 binding arm. The structure of the bispecific antibodies with Vβ17 Fab is illustrated in FIG. 26A. The structure of the bispecific antibodies with Vβ17 Fab is illustrated in FIG. 26B.
Figure 26B:
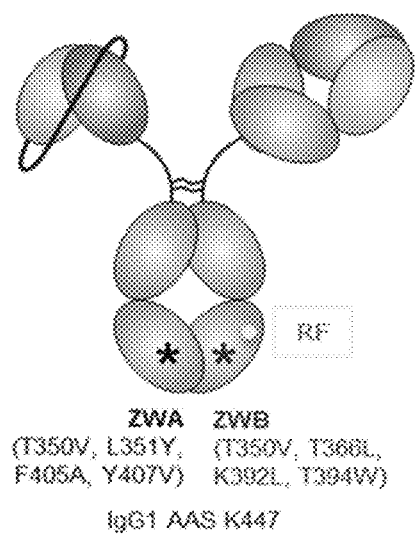

Anti-Vβ17 and anti-BCMA antibodies and bispecific were generated as previously described. Table 52 provides a description for the anti-Vβ17/anti-BCMA bispecific antibodies that were generated. The sequences of the antibodies are described in the Sequence Listing. The structure of the bispecific antibodies with Vβ17 Fab is illustrated in FIG. 26A. The structure of the bispecific antibodies with Vβ17 Fab is illustrated in FIG. 26B.

TABLE 52

Description of anti-Vβ17/anti-BCMA bispecific antibodies

| Sr. No. | Name | Description |
|---|---|---|
| 1. | V7BCB30 | HC1 (ZWA): B17B860-G34Q-LH-scFv; HC2 (ZWB): B21M-Fab-RF |
| 2. | V7BCB31 | HC1 (ZWA): B17B860-G34Q-LH-scFv; HC2 (ZWB): BCMB519-Fab-RF |
| 3. | V7BCB32 | HC1 (ZWA): B17B860-G34K-LH-scFv; HC2 (ZWB): B21M-Fab-RF |
| 4. | V7BCB33 | HC1 (ZWA): B17B860-G34K-LH-scFv; HC2 (ZWB): BCMB519-Fab-RF |
| 5. | V7BCB34 | HC1 (ZWA): B17B852-N33T-LH-scFv; HC2 (ZWB): B21M-Fab-RF |
| 6. | V7BCB35 | HC1 (ZWA): B17B852-N33T-LH-scFv; HC2 (ZWB): BCMB519-Fab-RF |
| 7. | V7BCB36 | HC1 (ZWA): B17B852-G34R-LH-scFv; HC2 (ZWB): B21M-Fab-RF |
| 8. | V7BCB37 | HC1 (ZWA): B17B852-G34R-LH-scFv; HC2 (ZWB): BCMB519-Fab-RF |
| 9. | V7BCB38 | HC1 (ZWA): B17B852-G34K-LH-scFv; HC2 (ZWB): B21M-Fab-RF |
| 10. | V7BCB39 | HC1 (ZWA): B17B852-G34K-LH-scFv; HC2 (ZWB): BCMB519-Fab-RF |
| 11. | V7BCB40 | HC1 (ZWA): Vb17-B17B21-N33S-LH-scFv; HC2 (ZWB): B21M-Fab-RF |
| 12. | V7BCB41 | HC1 (ZWA): Vb17-B17B21-N33S-LH-scFv; HC2 (ZWB): BCMB519-Fab-RF |
| 13. | V7BCB42 | HC1 (ZWA): Null-LH-MSCD334-scFv; HC2 (ZWB): B21M-Fab-RF |
| 14. | V7BCB43 | HC1 (ZWA): Null-LH-MSCD334-scFv; HC2 (ZWB): BCMB519-Fab-RF |
| 15. | V7BCB44 | HC1 (ZWA): B21M-Fab_RF; HC2 (ZWB): BCMB519-LH-scFv |
| 16. | V7BCB45 | HC1 (ZWA): B17B860-G34Q-Fab_RF; HC2 (ZWB): BCMB519-LH-scFv |
| 17. | V7BCB46 | HC1 (ZWA): B17B860-G34K-Fab_RF; HC2 (ZWB): BCMB519-LH-scFv |
| 18. | V7BCB47 | HC1 (ZWA): B17B852-N33T-Fab_RF; HC2 (ZWB): BCMB519-LH-scFv |
| 19. | V7BCB48 | HC1 (ZWA): B17B852-G34R-Fab_RF; HC2 (ZWB): BCMB519-LH-scFv |
| 20. | V7BCB49 | HC1 (ZWA): B17B852-G34K-Fab_RF; HC2 (ZWB): BCMB519-LH-scFv |
| 21. | V7BCB50 | HC1 (ZWA): Vb17-B17B21-N33S-Fab_RF; HC2 (ZWB): BCMB519-LH-scFv |
| 22. | V7BCB51 | HC1 (ZWA): B17B860-G34Q-Fab-RF; HC2 (ZWB): Null-LH-MSCD334-scFv |
| 23. | V7BCB52 | HC1 (ZWA): B17B860-G34K-Fab-RF; HC2 (ZWB): Null-LH-MSCD334-scFv |
| 24. | V7BCB53 | HC1 (ZWA): B17B852-N33T-Fab-RF; HC2 (ZWB): Null-LH-MSCD334-scFv |
| 25. | V7BCB54 | HC1 (ZWA): B17B852-G34R-Fab-RF; HC2 (ZWB): Null-LH-MSCD334-scFv |
| 26. | V7BCB55 | HC1 (ZWA): B17B852-G34K-Fab-RF; HC2 (ZWB): Null-LH-MSCD334-scFv |
| 27. | V7BCB56 | HC1 (ZWA): Vb17-B17B21-N33S-Fab-RF; HC2 (ZWB): Null-LH-MSCD334-scFv |
| 28. | V7BCB57 | HC1 (ZWA): B21M-Fab-RF; HC2 (ZWB): Null-LH-MSCD334-scFv |

Example 8.2: Evaluation of Binding and Cytotoxic Properties of the Anti-Vβ17/Anti-BCMA Bispecific Antibody Using H929 Cells and Human T Cells Binding assays and cytotoxicity assays were performed as previously described. $EC_{50}$ values were calculated as described in methods. Binding assays (see Table 53) show that the anti-Vβ17/anti-BCMA bispecific antibodies bind T cells. Cytotoxicity assays (see Table 53) show that anti-Vβ17/anti-BCMA bispecific antibodies mediated T cell cytotoxicity against BCMA expressing H929 cells in vitro.

TABLE 53

Binding data and cytoxicity data for anti-Vβ17/anti-BCMA bispecific antibodies

| | | Killing data | | | | |
|---|---|---|---|---|---|---|
| Antibody | Binding data EC50 (ug/ml) | EC50 (ug/ml)-Donor 1 | EC50 (ug/ml)-Donor 2 | Max killing (Donor 1) | Max killing (Donor 2) | Area under the curve (D1) |
| V7BCB30 | 1.31 | ~0 | ~0 | ~0 | ~0 | ~0 |
| V7BCB31 | 0.98 | 0.02 | 0.02 | 76.57 | 83.32 | 182.5 |
| V7BCB32 | 2.08 | ~0 | ~0 | ~0 | ~0 | ~0 |
| V7BCB33 | 1.76 | ~0.02 | 0.02 | 75.53 | 81.62 | 188.2 |
| V7BCB34 | 1.79 | ~0 | ~0 | ~0 | ~0 | ~0 |
| V7BCB35 | 1.83 | 0.05 | 0.06 | 71.24 | 69.82 | 129.3 |
| V7BCB36 | 0.54 | ~0 | ~0 | ~0 | ~0 | ~0 |
| V7BCB37 | 0.44 | 0.01 | 0.03 | 77.83 | 78.75 | 179 |
| V7BCB38 | 1.86 | ~0 | ~0 | ~0 | ~0 | ~0 |
| V7BCB39 | 1.20 | 0.02 | 0.04 | 74.07 | 80.44 | 161.1 |
| V7BCB40 | 4.07 | ~0 | ~0 | ~0 | ~0 | ~0 |
| V7BCB41 | 3.43 | ~0.006 | 0.03 | 72.04 | 82.55 | 197.1 |
| V7BCB42 | N/A | ~0 | ~0 | ~0 | ~0 | ~0 |
| V7BCB43 | N/A | ~0 | ~0 | ~0 | ~0 | ~0 |
| V7BCB44 | N/A | ~0 | ~0 | ~0 | ~0 | ~0 |
| V7BCB45 | 0.20 | 0.02 | 0.03 | 80.84 | 88.88 | 183.2 |
| V7BCB46 | 0.43 | 0.02 | 0.02 | 79.59 | 88.51 | 179.2 |
| V7BCB47 | 0.15 | 0.03 | 0.03 | 81.92 | 89.82 | 176.5 |
| V7BCB48 | 0.09 | 0.03 | 0.02 | 81.8 | 88.88 | 182.9 |
| V7BCB49 | 0.45 | 0.01 | 0.02 | 81.96 | 89.23 | 196.5 |
| V7BCB50 | 0.16 | 0.01 | 0.01 | 76.96 | 88.25 | 186.9 |
| V7BCB51 | 0.37 | ~0 | ~0 | ~0 | ~0 | ~0 |
| V7BCB52 | 0.89 | ~0 | ~0 | ~0 | ~0 | ~0 |
| V7BCB53 | 0.44 | ~0 | ~0 | ~0 | ~0 | ~0 |
| V7BCB54 | 0.20 | ~0 | ~0 | ~0 | ~0 | ~0 |
| V7BCB55 | 0.53 | ~0 | N/A | N/A | N/A | N/A |

TABLE 53-continued

Binding data and cytotoxicity data for anti-Vβ17/anti-BCMA bispecific antibodies

| Antibody | Binding data EC50 (ug/ml) | Killing data | | | | |
|---|---|---|---|---|---|---|
| | | EC50 (ug/ml)- Donor 1 | EC50 (ug/ml)- Donor 2 | Max killing (Donor 1) | Max killing (Donor 2) | Area under the curve (D1) |
| V7BCB56 | 0.84 | ~0 | N/A | N/A | N/A | N/A |
| V7BCB57 | N/A | ~0 | ~0 | ~0 | ~0 | ~0 |

Example 8.3: Activation of Vβ17 T Cells by Anti-Vβ17/Anti-BCMA Bispecific Antibodies Pan T cells were cultured on plates coated with Vβ17×BCMA antibodies for 96 hours. At the end of the culture period activation of Vβ17 T cells was checked using CD25 (Table 54), CD69 (Table 55), CD71 (Table 56) and proliferation (Table 57). As shown below in Tables 54-57, the Vβ17×BCMA antibodies showed a strong enhancement of Vβ17 T cell activation as indicated by the upregulation of CD25, CD69 and CD71 expression on Vβ17 T cells and an increase in the proliferation of Vβ17 T cells. Control antibodies did not show activation of Vβ17 T cells.

TABLE 54

Activation of Vβ17 T cells as measured by CD25 expression by anti-Vβ17/anti-BCMA bispecific antibodies

| Antibody | CD25 EC50 donor 1 (ug/ml) | CD25 EC50 donor 2 (ug/ml) | CD25 AUC donor 1 | CD25 AUC donor 2 | CD25 EC50 donor 1 (ug/ml) |
|---|---|---|---|---|---|
| V7BCB30 | ~0 | ~0 | ~0 | ~0 | ~0 |
| V7BCB31 | 0.035 | 0.077 | 24.480 | 34.290 | 0.035 |
| V7BCB32 | ~0 | ~0 | ~0 | ~0 | ~0 |
| V7BCB33 | 0.060 | 0.679 | 17.420 | 35.450 | 0.060 |
| V7BCB34 | ~0 | ~0 | ~0 | ~0 | ~0 |
| V7BCB35 | 0.043 | 0.091 | 23.010 | 38.630 | 0.043 |
| V7BCB36 | ~0 | ~0 | ~0 | ~0 | ~0 |
| V7BCB37 | N/A | 0.036 | 20.390 | 39.330 | N/A |
| V7BCB38 | ~0 | ~0 | ~0 | ~0 | ~0 |
| V7BCB39 | N/A | 0.084 | 24.720 | 38.600 | N/A |
| V7BCB40 | ~0 | ~0 | ~0 | ~0 | ~0 |
| V7BCB41 | 0.062 | N/A | 18.720 | 19.990 | 0.062 |
| V7BCB42 | ~0 | ~0 | ~0 | ~0 | ~0 |
| V7BCB43 | N/A | N/A | 1.440 | 1.303 | N/A |
| V7BCB44 | N/A | N/A | 0.446 | 0.772 | N/A |
| V7BCB45 | 0.013 | N/A | 73.580 | 99.670 | 0.013 |
| V7BCB46 | 0.016 | 0.028 | 86.260 | 85.790 | 0.016 |
| V7BCB47 | 0.017 | 0.019 | 82.460 | 80.490 | 0.017 |
| V7BCB48 | N/A | N/A | 0.357 | 1.642 | N/A |
| V7BCB49 | 0.015 | 0.026 | 90.950 | 82.780 | 0.015 |
| V7BCB50 | 0.011 | 0.009 | 101.300 | 103.000 | 0.011 |
| V7BCB51 | ~0 | ~0 | ~0 | ~0 | ~0 |
| V7BCB52 | ~0 | ~0 | ~0 | ~0 | ~0 |
| V7BCB53 | ~0 | ~0 | ~0 | ~0 | ~0 |
| V7BCB54 | ~0 | ~0 | ~0 | ~0 | ~0 |
| V7BCB55 | ~0 | ~0 | ~0 | ~0 | ~0 |
| V7BCB56 | ~0 | ~0 | ~0 | ~0 | ~0 |
| V7BCB57 | ~0 | ~0 | ~0 | ~0 | ~0 |

TABLE 55

Activation of Vβ17 T cells as measured by CD69 expression by anti-Vβ17/anti-BCMA bispecific antibodies

| Antibody | CD69 EC50 donor 1 (ug/ml) | CD69 EC50 donor 2 (ug/ml) | CD69 AUC donor 1 | CD69 AUC donor 2 | CD69 EC50 donor 1 (ug/ml) |
|---|---|---|---|---|---|
| V7BCB30 | ~0 | ~0 | ~0 | ~0 | ~0 |
| V7BCB31 | 0.025 | 0.015 | 130.000 | 104.500 | 0.025 |
| V7BCB32 | ~0 | ~0 | ~0 | ~0 | ~0 |
| V7BCB33 | 0.140 | N/A | 114.600 | 80.370 | 0.140 |
| V7BCB34 | ~0 | ~0 | ~0 | ~0 | ~0 |
| V7BCB35 | 0.009 | 0.036 | 131.000 | 103.700 | 0.009 |
| V7BCB36 | ~0 | ~0 | ~0 | ~0 | ~0 |
| V7BCB37 | 0.014 | N/A | 135.100 | 88.600 | 0.014 |
| V7BCB38 | ~0 | ~0 | ~0 | ~0 | ~0 |
| V7BCB39 | 0.022 | N/A | 129.500 | 102.000 | 0.022 |
| V7BCB40 | ~0 | ~0 | ~0 | ~0 | ~0 |
| V7BCB41 | 0.183 | 0.027 | 93.290 | 79.660 | 0.183 |
| V7BCB42 | ~0 | ~0 | ~0 | ~0 | ~0 |
| V7BCB43 | N/A | N/A | 13.300 | 4.262 | N/A |
| V7BCB44 | N/A | N/A | N/A | 4.946 | N/A |
| V7BCB45 | N/A | N/A | 235.500 | 202.700 | N/A |
| V7BCB46 | 0.004 | N/A | 231.900 | 178.200 | 0.004 |
| V7BCB47 | 0.007 | N/A | 228.700 | 200.000 | 0.007 |
| V7BCB48 | N/A | N/A | 24.510 | 12.580 | N/A |
| V7BCB49 | N/A | N/A | 222.000 | 169.100 | N/A |
| V7BCB50 | N/A | N/A | 254.400 | 173.500 | N/A |
| V7BCB51 | ~0 | ~0 | ~0 | ~0 | ~0 |
| V7BCB52 | ~0 | ~0 | ~0 | ~0 | ~0 |
| V7BCB53 | ~0 | ~0 | ~0 | ~0 | ~0 |
| V7BCB54 | ~0 | ~0 | ~0 | ~0 | ~0 |
| V7BCB55 | ~0 | ~0 | ~0 | ~0 | ~0 |
| V7BCB56 | ~0 | ~0 | ~0 | ~0 | ~0 |
| V7BCB57 | ~0 | ~0 | ~0 | ~0 | ~0 |

TABLE 56

Activation of Vβ17 T cells as measured by CD71 expression by anti-Vβ17/anti-BCMA bispecific antibodies

| Antibody | CD71 EC50 donor 1 (ug/ml) | CD71 EC50 donor 2 (ug/ml) | CD71 AUC donor 1 | CD71 AUC donor 2 | CD71 EC50 donor 1 (ug/ml) |
|---|---|---|---|---|---|
| V7BCB30 | ~0 | ~0 | ~0 | ~0 | ~0 |
| V7BCB31 | 0.017 | 0.069 | 77.060 | 79.730 | 0.017 |
| V7BCB32 | ~0 | ~0 | ~0 | ~0 | ~0 |
| V7BCB33 | 0.120 | N/A | 65.370 | 52.740 | 0.120 |
| V7BCB34 | ~0 | ~0 | ~0 | ~0 | ~0 |
| V7BCB35 | 0.022 | 0.054 | 102.800 | 81.620 | 0.022 |
| V7BCB36 | ~0 | ~0 | ~0 | ~0 | ~0 |
| V7BCB37 | 0.026 | N/A | 100.900 | 73.570 | 0.026 |
| V7BCB38 | ~0 | ~0 | ~0 | ~0 | ~0 |
| V7BCB39 | 0.020 | N/A | 94.980 | 83.930 | 0.020 |
| V7BCB40 | ~0 | ~0 | ~0 | ~0 | ~0 |
| V7BCB41 | 0.305 | 0.012 | 61.920 | 59.300 | 0.305 |
| V7BCB42 | ~0 | ~0 | ~0 | ~0 | ~0 |
| V7BCB43 | N/A | N/A | 37.140 | 16.770 | N/A |
| V7BCB44 | N/A | N/A | 17.960 | 21.540 | N/A |
| V7BCB45 | 0.007 | ND | 244.400 | 253.000 | 0.007 |
| V7BCB46 | 0.014 | 0.009 | 236.200 | 247.800 | 0.014 |
| V7BCB47 | 0.008 | 0.005 | 218.300 | 226.700 | 0.008 |
| V7BCB48 | N/A | N/A | 23.440 | 28.430 | N/A |
| V7BCB49 | 0.005 | 0.010 | 213.200 | 249.600 | 0.005 |
| V7BCB50 | 0.007 | N/A | 256.600 | 268.400 | 0.007 |
| V7BCB51 | ~0 | ~0 | ~0 | ~0 | ~0 |
| V7BCB52 | ~0 | ~0 | ~0 | ~0 | ~0 |
| V7BCB53 | ~0 | ~0 | ~0 | ~0 | ~0 |
| V7BCB54 | ~0 | ~0 | ~0 | ~0 | ~0 |
| V7BCB55 | ~0 | ~0 | ~0 | ~0 | ~0 |
| V7BCB56 | ~0 | ~0 | ~0 | ~0 | ~0 |
| V7BCB57 | ~0 | ~0 | ~0 | ~0 | ~0 |

TABLE 57

Activation of Vβ17 T cells as measured proliferation by anti-Vβ17/anti-BCMA bispecific antibodies

| Antibody | proliferation EC50 donor 1 (ug/ml) | proliferation EC50 donor 2 (ug/ml) | proliferation AUC donor 1 | proliferation AUC donor 2 | proliferation EC50 donor 1 (ug/ml) |
|---|---|---|---|---|---|
| V7BCB30 | ~0 | ~0 | ~0 | ~0 | ~0 |
| V7BCB31 | 0.230 | N/A | 29.950 | 7.097 | 0.230 |
| V7BCB32 | ~0 | ~0 | ~0 | ~0 | ~0 |
| V7BCB33 | 0.696 | N/A | 32.900 | 4.763 | 0.696 |
| V7BCB34 | ~0 | ~0 | ~0 | ~0 | ~0 |
| V7BCB35 | 0.077 | 0.069 | 49.370 | 12.340 | 0.077 |
| V7BCB36 | ~0 | ~0 | ~0 | ~0 | ~0 |
| V7BCB37 | 0.026 | N/A | 39.730 | 7.926 | 0.026 |
| V7BCB38 | ~0 | ~0 | ~0 | ~0 | ~0 |
| V7BCB39 | 0.022 | N/A | 42.500 | 3.849 | 0.022 |
| V7BCB40 | ~0 | ~0 | ~0 | ~0 | ~0 |
| V7BCB41 | 0.099 | N/A | 24.380 | 5.174 | 0.099 |
| V7BCB42 | ~0 | ~0 | ~0 | ~0 | ~0 |
| V7BCB43 | N/A | N/A | 2.565 | 0.292 | N/A |
| V7BCB44 | N/A | N/A | 3.491 | 5.950 | N/A |
| V7BCB45 | 0.003 | 0.020 | 106.500 | 104.800 | 0.003 |
| V7BCB46 | 0.025 | 0.018 | 91.630 | 106.500 | 0.025 |
| V7BCB47 | 0.024 | 0.020 | 99.810 | 121.900 | 0.024 |
| V7BCB48 | N/A | N/A | 2.760 | 7.285 | N/A |
| V7BCB49 | 0.095 | 0.015 | 109.200 | 139.300 | 0.095 |
| V7BCB50 | N/A | N/A | 86.090 | 103.400 | N/A |
| V7BCB51 | ~0 | ~0 | ~0 | ~0 | ~0 |
| V7BCB52 | ~0 | ~0 | ~0 | ~0 | ~0 |
| V7BCB53 | ~0 | ~0 | ~0 | ~0 | ~0 |
| V7BCB54 | ~0 | ~0 | ~0 | ~0 | ~0 |
| V7BCB55 | ~0 | ~0 | ~0 | ~0 | ~0 |
| V7BCB56 | ~0 | ~0 | ~0 | ~0 | ~0 |
| V7BCB57 | ~0 | ~0 | ~0 | ~0 | ~0 |

Example 9: Exemplary Antibodies and Sequences

Additional details of exemplary antibodies used in certain Examples herein are provided in Table 59 and Table 60.

TABLE 59

Exemplary Vβ17 Antibody Clones.

| | Target | VH SEQ ID | VL SEQ ID | VH CDR1* SEQ ID | VH CDR2 SEQ ID | VH CDR3 SEQ ID | VL CDR1 SEQ ID | VL CDR2 SEQ ID | VL CDR3 SEQ ID |
|---|---|---|---|---|---|---|---|---|---|
| E17.5F | Vβ17 | 25 | 26 | 1 | 2 | 3 | 4 | 5 | 6 |
| B17B1 | Vβ17 | 25 | 26 | 1 | 2 | 3 | 4 | 5 | 6 |
| B17H1 | Vβ17 | 25 | 26 | 1 | 2 | 3 | 4 | 5 | 6 |
| B17H3 | Vβ17 | 19 | 22 | 1 | 2 | 3 | 4 | 5 | 6 |
| B17H4 | Vβ17 | 20 | 23 | 1 | 2 | 3 | 4 | 5 | 6 |
| B17H5 | Vβ17 | 21 | 24 | 1 | 2 | 3 | 4 | 5 | 6 |
| B17B14 | Vβ17 | 19 | 22 | 1 | 2 | 3 | 4 | 5 | 6 |
| B17B15 | Vβ17 | 19 | 23 | 1 | 2 | 3 | 4 | 5 | 6 |
| B17B16 | Vβ17 | 19 | 24 | 1 | 2 | 3 | 4 | 5 | 6 |
| B17B17 | Vβ17 | 20 | 22 | 1 | 2 | 3 | 4 | 5 | 6 |
| B17B18 | Vβ17 | 20 | 23 | 1 | 2 | 3 | 4 | 5 | 6 |
| B17B19 | Vβ17 | 20 | 24 | 1 | 2 | 3 | 4 | 5 | 6 |
| B17B20 | Vβ17 | 21 | 22 | 1 | 2 | 3 | 4 | 5 | 6 |
| B17B21 | Vβ17 | 21 | 23 | 1 | 2 | 3 | 4 | 5 | 6 |
| B17B22 | Vβ17 | 21 | 24 | 1 | 2 | 3 | 4 | 5 | 6 |
| B17B2 | Vβ17 | 46 | 47 | 45 | 2 | 3 | 4 | 5 | 6 |
| Vb17_202B4D1 | Vβ17 | 77 | 78 | 48 | 49 | 50 | 51 | 52 | 53 |
| Vb17_210E10A1 | Vβ17 | 79 | 80 | 48 | 54 | 55 | 56 | 57 | 58 |
| B17B663 | Vβ17 | 81 | 82 | 59 | 49 | 60 | 61 | 62 | 63 |
| B17B694 | Vβ17 | 83 | 84 | 64 | 65 | 66 | 67 | 68 | 69 |
| B17B698 | Vβ17 | 85 | 86 | 70 | 49 | 71 | 61 | 72 | 73 |
| B17B733 | Vβ17 | 87 | 88 | 48 | 74 | 75 | 56 | 57 | 76 |
| Vb17_N33S | Vβ17 | 21 | 665 | 1 | 2 | 3 | 664 | 5 | 6 |
| B17B860_G34Q | Vβ17 | 1000 | 1001 | 979 | 980 | 981 | 994 | 995 | 996 |
| B17B852_G34R | Vβ17 | 1032 | 1033 | 1011 | 1012 | 1013 | 1026 | 1027 | 1028 |
| B17B860_G34K | Vβ17 | 1064 | 1065 | 1043 | 1044 | 1045 | 1058 | 1059 | 1060 |

TABLE 59-continued

Exemplary Vβ17 Antibody Clones.

| Target | VH SEQ ID | VL SEQ ID | VH CDR1* SEQ ID | VH CDR2 SEQ ID | VH CDR3 SEQ ID | VL CDR1 SEQ ID | VL CDR2 SEQ ID | VL CDR3 SEQ ID |
|---|---|---|---|---|---|---|---|---|
| B17B852_N33T | Vβ17 | 1096 | 1097 | 1075 | 1076 | 1077 | 1090 | 1091 | 1092 |
| B17B852_G34K | Vβ17 | 1128 | 1129 | 1107 | 1108 | 1109 | 1122 | 1123 | 1124 |

*VH CDR1-3 and VL CDR1-3 sequences shown by single definition only. Other CDR definitions known in the art may also be utilized (e.g., Exemplary, Kabat, Chothia, AbM, IMGT, and/or Contact) and are provided herein.

TABLE 60

Exemplary Multispecific Antibodies.

| Name | Description | HC 1 Iso-type | HC 1 SEQ ID | LC 1 Iso-type | LC 1 SEQ ID | HC 2 Iso-type | HC 2 SEQ ID | LC 2 Iso-type | LC 1 SEQ ID |
|---|---|---|---|---|---|---|---|---|---|
| V7BCB30 | HC1 (ZWA): B17B860-G34Q-LH-scFv; HC2 (ZWB): B21M-Fab-RF | IgG1 | 1213 | NA | NA | IgG1 | 1171 | Kappa | 1199 |
| V7BCB31 | HC1 (ZWA): B17B860-G34Q-LH-scFv; HC2 (ZWB): BCMB519-Fab-RF | IgG1 | 1130 | NA | NA | IgG1 | 1172 | Kappa | 1200 |
| V7BCB32 | HC1 (ZWA): B17B860-G34K-LH-scFv; HC2 (ZWB): B21M-Fab-RF | IgG1 | 1131 | NA | NA | IgG1 | 1173 | Kappa | 1201 |
| V7BCB33 | HC1 (ZWA): B17B860-G34K-LH-scFv; HC2 (ZWB): BCMB519-Fab-RF | IgG1 | 1132 | NA | NA | IgG1 | 1174 | Kappa | 1202 |
| V7BCB34 | HC1 (ZWA): B17B852-N33T-LH-scFv; HC2 (ZWB): B21M-Fab-RF | IgG1 | 1133 | NA | NA | IgG1 | 1175 | Kappa | 1203 |
| V7BCB35 | HC1 (ZWA): B17B852-N33T-LH-scFv; HC2 (ZWB): BCMB519-Fab-RF | IgG1 | 1134 | NA | NA | IgG1 | 1176 | Kappa | 1204 |
| V7BCB36 | HC1 (ZWA): B17B852-G34R-LH-scFv; HC2 (ZWB): B21M-Fab-RF | IgG1 | 1135 | NA | NA | IgG1 | 1177 | Kappa | 1205 |
| V7BCB37 | HC1 (ZWA): B17B852-G34R-LH-scFv; HC2 (ZWB): BCMB519-Fab-RF | IgG1 | 1136 | NA | NA | IgG1 | 1178 | Kappa | 1206 |
| V7BCB38 | HC1 (ZWA): B17B852-G34K-LH-scFv; HC2 (ZWB): B21M-Fab-RF | IgG1 | 1137 | NA | NA | IgG1 | 1179 | Kappa | 1207 |
| V7BCB39 | HC1 (ZWA): B17B852-G34K-LH-scFv; HC2 (ZWB): BCMB519-Fab-RF | IgG1 | 1138 | NA | NA | IgG1 | 1180 | Kappa | 1208 |
| V7BCB40 | HC1 (ZWA): Vb17-B17B21-N335-LH-scFv; HC2 (ZWB): B21M-Fab-RF | IgG1 | 1139 | NA | NA | IgG1 | 1181 | Kappa | 1209 |
| V7BCB41 | HC1 (ZWA): Vb17-B17B21-N335-LH-scFv; HC2 (ZWB): BCMB519-Fab-RF | IgG1 | 1140 | NA | NA | IgG1 | 1182 | Kappa | 1210 |
| V7BCB42 | HC1 (ZWA): Null-LH-M5CD334-scFv; HC2 (ZWB): B21M-Fab-RF | IgG1 | 1141 | NA | NA | IgG1 | 1183 | Kappa | 1211 |
| V7BCB43 | HC1 (ZWA): Null-LH-M5CD334-scFv; HC2 (ZWB): BCMB519-Fab-RF | IgG1 | 1142 | NA | NA | IgG1 | 1184 | Kappa | 1212 |
| V7BCB44 | HC1 (ZWA): B21M-Fab_RF; HC2 (ZWB): BCMB519-LH-scFv | IgG1 | 1143 | Kappa | 1157 | IgG1 | 1185 | NA | NA |
| V7BCB45 | HC1 (ZWA): B17B860-G34Q-Fab_RF; HC2 (ZWB): BCMB519-LH-scFv | IgG1 | 1144 | Kappa | 1158 | IgG1 | 1186 | NA | NA |
| V7BCB46 | HC1 (ZWA): B17B860-G34K-Fab_RF; HC2 (ZWB): BCMB519-LH-scFv | IgG1 | 1145 | Kappa | 1159 | IgG1 | 1187 | NA | NA |
| V7BCB47 | HC1 (ZWA): B17B852-N33T-Fab_RF; HC2 (ZWB): BCMB519-LH-scFv | IgG1 | 1146 | Kappa | 1160 | IgG1 | 1188 | NA | NA |
| V7BCB48 | HC1 (ZWA): B17B852-G34R-Fab_RF; HC2 (ZWB): BCMB519-LH-scFv | IgG1 | 1147 | Kappa | 1161 | IgG1 | 1189 | NA | NA |
| V7BCB49 | HC1 (ZWA): B17B852-G34K-Fab_RF; HC2 (ZWB): BCMB519-LH-scFv | IgG1 | 1148 | Kappa | 1162 | IgG1 | 1190 | NA | NA |
| V7BCB50 | HC1 (ZWA): Vb17-B17B21-N33S-Fab_RF; HC2 (ZWB): BCMB519-LH-scFv | IgG1 | 1149 | Kappa | 1163 | IgG1 | 1191 | NA | NA |
| V7BCB51 | HC1 (ZWA): B17B860-G34Q-Fab-RF; HC2 (ZWB): Null-LH-MSCD334-scFv | IgG1 | 1150 | Kappa | 1164 | IgG1 | 1192 | NA | NA |
| V7BCB52 | HC1 (ZWA): B17B860-G34K-Fab-RF; HC2 (ZWB): Null-LH-MSCD334-scFv | IgG1 | 1151 | Kappa | 1165 | IgG1 | 1193 | NA | NA |
| V7BCB53 | HC1 (ZWA): B17B852-N33T-Fab-RF; HC2 (ZWB): Null-LH-MSCD334-scFv | IgG1 | 1152 | Kappa | 1166 | IgG1 | 1194 | NA | NA |
| V7BCB54 | HC1 (ZWA): B17B852-G34R-Fab-RF; HC2 (ZWB): Null-LH-MSCD334-scFv | IgG1 | 1153 | Kappa | 1167 | IgG1 | 1195 | NA | NA |
| V7BCB55 | HC1 (ZWA): B17B852-G34K-Fab-RF; HC2 (ZWB): Null-LH-MSCD334-scFv | IgG1 | 1154 | Kappa | 1168 | IgG1 | 1196 | NA | NA |
| V7BCB56 | HC1 (ZWA): Vb17-B17B21-N33S-Fab-RF; HC2 (ZWB): Null-LH-MSCD334-scFv | IgG1 | 1155 | Kappa | 1169 | IgG1 | 1197 | NA | NA |

TABLE 60-continued

Exemplary Multispecific Antibodies.

| Name | Description | HC 1 Iso-type | HC 1 SEQ ID | LC 1 Iso-type | LC 1 SEQ ID | HC 2 Iso-type | HC 2 SEQ ID | LC 2 Iso-type | LC 1 SEQ ID |
|---|---|---|---|---|---|---|---|---|---|
| V7BCB57 | HC1 (ZWA): B21M-Fab-RF; HC2 (ZWB): Null-LH-MSCD334-scFv | IgG1 | 1156 | Kappa | 1170 | IgG1 | 1198 | NA | NA |

It will be appreciated by those skilled in the art that changes could be made to the embodiments described above without departing from the broad inventive concept thereof. It is understood, therefore, that this invention is not limited to the particular embodiments disclosed, but it is intended to cover modifications within the spirit and scope of the present invention as defined by the present description.

SEQUENCE LISTING (1213 sequences)

SEQ ID NO: 1 - protein, 11 aa, Artificial Sequence
  Description of Artificial Sequence: Synthetic peptide
  B17B01 HCDR1
GYSITSGYFWN

SEQ ID NO: 2 - protein, 9 aa, Artificial Sequence
  Description of Artificial Sequence: Synthetic peptide
  B17B01 HCDR2
YISYDGSNN

SEQ ID NO: 3 - protein, 11 aa, Artificial Sequence
  Description of Artificial Sequence: Synthetic peptide
  B17B01 HCDR3
PSPGTGYAVDY

SEQ ID NO: 4 - protein, 16 aa, Artificial Sequence
  Description of Artificial Sequence: Synthetic peptide
  B17B01 LCDR1
RSSQSLVHSNGNTYLH

SEQ ID NO: 5 - protein, 7 aa, Artificial Sequence
  Description of Artificial Sequence: Synthetic peptide
  B17B01 LCDR2
KVSNRFS

SEQ ID NO: 6 - protein, 9 aa, Artificial Sequence
  Description of Artificial Sequence: Synthetic peptide
  B17B01 LCDR3
SQSTHVPFT

SEQ ID NO: 7 - protein, 444 aa, Artificial Sequence
  Description of Artificial Sequence: Synthetic polypeptide
  B17B01 Heavy Chain
NVQLQESGPGLVKPSQSLSLTCSVAGYSITSGYFWNWIRQFPGNKLEWMGYISYDGSNNYNPSLKNRISITRDTSKNQFFLKLNSVTTEDTATYYCASPSPGTGYAVDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCGCKPCICTVPEVSSVFIFPPKPKDVLTITLTPKVTCVVVDISKDDPEVQFSWFVDDVEVHTAQTKPREEQINSTFRSVSELPIMHQDWLNGKEFKCRVNSAAFPAPIEKTISKTYGRPKAPQVYTIPPPKEQMAKDKVSLTCMITNFFPEDITVEWQWNGQPAENYKNTQPIMDTDGSYFVYSKLNVQKSNWEAGNTFTCSVLHEGLHNHHTEKSLSHSPGK

SEQ ID NO: 8 - protein, 219 aa, Artificial Sequence
  Description of Artificial Sequence: Synthetic polypeptide
  B17B01 Light Chain
NVVMTQTPLSLPVSLGDQASISCRSSQSLVHSNGNTYLHWYLQKPGQSPKFLIYKVSNRFSGVPDRFSGGGSGTEFTLKISRVEAEDLGVYFCSQSTHVPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 9 - protein, 447 aa, Artificial Sequence
  Description of Artificial Sequence: Synthetic polypeptide
  B17B1 Heavy Chain
NVQLQESGPGLVKPSQSLSLTCSVAGYSITSGYFWNWIRQFPGNKLEWMGYISYDGSNNYNPSLKNRISITRDTSKNQFFLKLNSVTTEDTATYYCASPSPGTGYAVDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK

SEQ ID NO: 10 - protein, 219 aa, Artificial Sequence; identical to SEQ ID NO: 8
  Description of Artificial Sequence: Synthetic polypeptide
  B17B1 Light Chain

SEQ ID NO: 11 - protein, 447 aa, Artificial Sequence
  Description of Artificial Sequence: Synthetic polypeptide
  B17B2 Heavy Chain
DVQLKESGPGLVKPSQSLSVTCSVTGYSITSGYYWNWYRQFPGNKLEWMGYISYDGSNNYNPSLKNRISITRDTSKNQILLKLTYVTTEDTATYYCTRPSPGTGYAVDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFLLYSKLTVDKSRWQEGNVFSCSVMHEALHNHYTQKSLSLSLGK

SEQ ID NO: 12 - protein, 219 aa, Artificial Sequence
  Description of Artificial Sequence: Synthetic polypeptide
  B17B2 Light Chain
DIVMTQSPDSLAVSLGERATINCRSSQSLVHSNGNTYLHWYQQKPGQPPKLLIYKVSNRFSGVPDRFSGSGSGTDFTLTISSLQAEDVAVYYCSQSTHVPFTFGQGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 13 - protein, 447 aa, Artificial Sequence
  Description of Artificial Sequence: Synthetic polypeptide
  B17B21 Heavy Chain
QVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLSCAVKGFYPSDIAVEWESNGQPENNYKTTPPVLDSDGSFFLVSRLTVDKSRWQEGNVFSCSVMHEALHNRFTQKSLSLSLGK

SEQ ID NO: 14 - protein, 219 aa, Artificial Sequence
  Description of Artificial Sequence: Synthetic polypeptide
  B17B21 Light Chain
DIQMTQSPSSLSASVGDRVTITCRSSQSLVHSNGNTYLHWYQQKPGKAPKFLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 445 aa, Artificial Sequence
  Description of Artificial Sequence: Synthetic polypeptide
  I3RB217 Heavy Chain
EVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLWCLVKGFYPSDIAVEWESNGQPENNYKTTPPVLDSDGSFFLYSRLTVDKSRWQEGNVFSCSVMHEALHNHYTQKSLSLSLGK

SEQ ID NO: 16 - protein, 215 aa, Artificial Sequence
  Description of Artificial Sequence: Synthetic polypeptide
  I3RB217 Light Chain
EIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 447 aa, Artificial Sequence
  Description of Artificial Sequence: Synthetic polypeptide
  Null Heavy Chain
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLWCLVKGFYPSDIAVEWESNGQPENNYKTTPPVLDSDGSFFLYSRLTVDKSRWQEGNVFSCSVMHEALHNHYTQKSLSLSLGK

SEQ ID NO: 18 - protein, 218 aa, Artificial Sequence
  Description of Artificial Sequence: Synthetic polypeptide
  Null Light Chain
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - protein, 119 aa, Artificial Sequence
  Description of Artificial Sequence: Synthetic polypeptide
  B17H3
EVQLLESGGGLVQPGGSLRLSCAASGYSITSGYFWNWVRQAPGKGLEWVSYISYDGSNNYADSVKGRFTISRDNSKNTLYLQMNSLRAEDTAVYYCAKPSPGTGYAVDYWGQGTLVTVS

SEQ ID NO: 20 - protein, 120 aa, Artificial Sequence
  Description of Artificial Sequence: Synthetic polypeptide
  B17H4
EVQLLESGGGLVQPGGSLRLSCAASGYSITSGYFWNWVRQAPGKGLEWVSYISYDGSNNYADSVKGRFTISRDNSKNTLYLQMNSLRAEDTAVYYCASPSPGTGYAVDYWGQGTLVTVSS

SEQ ID NO: 21 - protein, 120 aa, Artificial Sequence
  Description of Artificial Sequence: Synthetic polypeptide
  B17H5
QVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSS

SEQ ID NO: 22 - protein, 112 aa, Artificial Sequence
  Description of Artificial Sequence: Synthetic polypeptide
  B17L3
DIQMTQSPSSLSASVGDRVTITCRSSQSLVHSNGNTYLHWYQQKPGKAPKLLIYKVSNRFSGVPSRFSGSGSGTDFTLTISSLQPEDFATYYCSQSTHVPFTFGQGTKLEIK

SEQ ID NO: 23 - protein, 112 aa, Artificial Sequence
  Description of Artificial Sequence: Synthetic polypeptide
  B17L4
DIQMTQSPSSLSASVGDRVTITCRSSQSLVHSNGNTYLHWYQQKPGKAPKFLIYKVSNRFSGVPSRFSGSGSGTDFTLTISSLQPEDFATYYCSQSTHVPFTFGQGTKLEIK

SEQ ID NO: 24 - protein, 112 aa, Artificial Sequence
  Description of Artificial Sequence: Synthetic polypeptide
  B17L5
DVVMTQSPLSLPVTLGQPASISCRSSQSLVHSNGNTYLHWFQQRPGQSPRFLIYKVSNRFSGVPDRFSGSGSGTDFTLKISRVEAEDVGVYYCSQSTHVPFTFGQGTKLEIK

SEQ ID NO: 25 - protein, 120 aa, Artificial Sequence
  Description of Artificial Sequence: Synthetic polypeptide
  B17H1
NVQLQESGPGLVKPSQSLSLTCSVAGYSITSGYFWNWIRQFPGNKLEWMGYISYDGSNNYNPSLKNRISITRDTSKNQFFLKLNSVTTEDTATYYCASPSPGTGYAVDYWGQGTSVTVSS

SEQ ID NO: 26 - protein, 112 aa, Artificial Sequence
  Description of Artificial Sequence: Synthetic polypeptide
  B17L1
NVVMTQTPLSLPVSLGDQASISCRSSQSLVHSNGNTYLHWYLQKPGQSPKFLIYKVSNRFSGVPDRFSGGGSGTEFTLKISRVEAEDLGVYFCSQSTHVPFTFGSGTKLEIK

SEQ ID NO: 27 - protein, 493 aa, Artificial Sequence
  Description of Artificial Sequence: Synthetic polypeptide
  TCR-Vbeta17_Fc fusion
MAWVWTLLFLMAAAQSIQAVDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSSRSSYEQYFGPGTRLTVTEDLKNVFPPEVAVFEPSEAEISHTQKATLVCLATGFYPDHVELSWWVNGKEVHSGVSTDPQPLKEQPALNDSRYSLSSRLRVSATFWQNPRNHFRCQVQFYGLSENDEWTQDRAKPVTQIVSAEAWGRADEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 28 - protein, 719 aa, Artificial Sequence
  Description of Artificial Sequence: Synthetic polypeptide
  B17B21 half antibody
MAWVWTLLFLMAAAQSIQADIQMTQSPSSLSASVGDRVTITCRSSQSLVHSNGNTYLHWYQQKPGKAPKFLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGSEGKSSGSGSESKSTEGKSSGSGSESKSTGGSQVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLSCAVKGFYPSDIAVEWESNGQPENNYKTTPPVLDSDGSFFLVSRLTVDKSRWQEGNVFSCSVMHEALHNRFTQKSLSLSLGK

SEQ ID NO: 29 - DNA, 4320 bp, Artificial Sequence
  Description of Artificial Sequence: Synthetic polynucleotide
  B17B21 half antibody
atggcctgggtgtggaccctgctgttcctgatggccgccgcccagagcatccaggccgacatccagatgacccagagcccaagcagcctgagcgccagcgtgggcgaccgcgtgaccatcacctgccgcagcagccagagcctggtgcacagcaacggcaacacctacctgcactggtaccagcagaagccaggcaaggccccaaagttcctgatctacaaggtgagcaaccgcttcagcggcgtgccaagccgcttcagcggcagcggcagcggcaccgacttcaccctgaccatcagcagcctgcagccagaggacttcgccacctactactgcagccagagcacccacgtgccattcaccttcggccagggcaccaagctggagatcaagcgcaccgtggccgccccaagcgtgttcatcttcccaccaagcgacgagcagctgaagagcggcaccgccagcgtggtgtgcctgctgaacaacttctacccacgcgaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagcccagtgaccaagagcttcaaccgcggcgagtgcggcggcagcgagggcaagagcagcggcagcggcagcgagagcaagagcaccgagggcaagagcagcggcagcggcagcgagagcaagagcaccggcggcagccaggtgcagctgcaggagagcggcccaggcctggtgaagccaagcgagaccctgagcctgacctgcaccgtgagcggctacagcatcaccagcggctacttctggaactggatccgccagccaccaggcaagggcctggagtggatcggctacatcagctacgacggcagcaacaactacaacccaagcctgaagagccgcgtgaccatcagccgcgacaccagcaagaaccagttcagcctgaagctgagcagcgtgaccgccgccgacaccgccgtgtactactgcgccagcccaagcccaggcaccggctacgccgtggactactggggccagggcaccctggtgaccgtgagcagcgccagcaccaagggcccaagcgtgttcccactggccccatgcagccgcagcaccagcgagagcaccgccgccctgggctgcctggtgaaggactacttcccagagccagtgaccgtgagctggaacagcggcgccctgaccagcggcgtgcacaccttcccagccgtgctgcagagcagcggcctgtacagcctgagcagcgtggtgaccgtgccaagcagcagcctgggcaccaagacctacacctgcaacgtggaccacaagccaagcaacaccaaggtggacaagcgcgtggagagcaagtacggcccaccatgcccaccatgcccagccccagaggccgccggcggcccaagcgtgttcctgttcccaccaaagccaaaggacaccctgatgatcagccgcaccccagaggtgacctgcgtggtggtggacgtgagccaggaggacccagaggtgcagttcaactggtacgtggacggcgtggaggtgcacaacgccaagaccaagccacgcgaggagcagttcaacagcacctaccgcgtggtgagcgtgctgaccgtgctgcaccaggactggctgaacggcaaggagtacaagtgcaaggtgagcaacaagggcctgccaagcagcatcgagaagaccatcagcaaggccaagggccagccacgcgagccacaggtgtacaccctgccaccaagccaggaggagatgaccaagaaccaggtgagcctgagctgcgccgtgaagggcttctacccaagcgacatcgccgtggagtgggagagcaacggccagccagagaacaactacaagaccaccccaccagtgctggacagcgacggcagcttcttcctggtgagccgcctgaccgtggacaagagccgctggcaggagggcaacgtgttcagctgcagcgtgatgcacgaggccctgcacaaccgcttcacccagaagagcctgagcctgagcctgggcaagatggcctgggtgtggaccctgctgttcctgatggccgccgcccagagcatccaggccgacatccagatgacccagagcccaagcagcctgagcgccagcgtgggcgaccgcgtgaccatcacctgccgcagcagccagagcctggtgcacagcaacggcaacacctacctgcactggtaccagcagaagccaggcaaggccccaaagttcctgatctacaaggtgagcaaccgcttcagcggcgtgccaagccgcttcagcggcagcggcagcggcaccgacttcaccctgaccatcagcagcctgcagccagaggacttcgccacctactactgcagccagagcacccacgtgccattcaccttcggccagggcaccaagctggagatcaagcgcaccgtggccgccccaagcgtgttcatcttcccaccaagcgacgagcagctgaagagcggcaccgccagcgtggtgtgcctgctgaacaacttctacccacgcgaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagcccagtgaccaagagcttcaaccgcggcgagtgcggcggcagcgagggcaagagcagcggcagcggcagcgagagcaagagcaccgagggcaagagcagcggcagcggcagcgagagcaagagcaccggcggcagccaggtgcagctgcaggagagcggcccaggcctggtgaagccaagcgagaccctgagcctgacctgcaccgtgagcggctacagcatcaccagcggctacttctggaactggatccgccagccaccaggcaagggcctggagtggatcggctacatcagctacgacggcagcaacaactacaacccaagcctgaagagccgcgtgaccatcagccgcgacaccagcaagaaccagttcagcctgaagctgagcagcgtgaccgccgccgacaccgccgtgtactactgcgccagcccaagcccaggcaccggctacgccgtggactactggggccagggcaccctggtgaccgtgagcagcgccagcaccaagggcccaagcgtgttcccactggccccatgcagccgcagcaccagcgagagcaccgccgccctgggctgcctggtgaaggactacttcccagagccagtgaccgtgagctggaacagcggcgccctgaccagcggcgtgcacaccttcccagccgtgctgcagagcagcggcctgtacagcctgagcagcgtggtgaccgtgccaagcagcagcctgggcaccaagacctacacctgcaacgtggaccacaagccaagcaacaccaaggtggacaagcgcgtggagagcaagtacggcccaccatgcccaccatgcccagccccagaggccgccggcggcccaagcgtgttcctgttcccaccaaagccaaaggacaccctgatgatcagccgcaccccagaggtgacctgcgtggtggtggacgtgagccaggaggacccagaggtgcagttcaactggtacgtggacggcgtggaggtgcacaacgccaagaccaagccacgcgaggagcagttcaacagcacctaccgcgtggtgagcgtgctgaccgtgctgcaccaggactggctgaacggcaaggagtacaagtgcaaggtgagcaacaagggcctgccaagcagcatcgagaagaccatcagcaaggccaagggccagccacgcgagccacaggtgtacaccctgccaccaagccaggaggagatgaccaagaaccaggtgagcctgagctgcgccgtgaagggcttctacccaagcgacatcgccgtggagtgggagagcaacggccagccagagaacaactacaagaccaccccaccagtgctggacagcgacggcagcttcttcctggtgagccgcctgaccgtggacaagagccgctggcaggagggcaacgtgttcagctgcagcgtgatgcacgaggccctgcacaaccgcttcacccagaagagcctgagcctgagcctgggcaagtgatag

SEQ ID NO: 30 - protein, 713 aa, Artificial Sequence
  Description of Artificial Sequence: Synthetic polypeptide
  I3RB217 half antibody
MAWVWTLLFLMAAAQSIQAEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGSEGKSSGSGSESKSTEGKSSGSGSESKSTGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLWCLVKGFYPSDIAVEWESNGQPENNYKTTPPVLDSDGSFFLYSRLTVDKSRWQEGNVFSCSVMHEALHNHYTQKSLSLSLGK

SEQ ID NO: 31 - DNA, 2139 bp, Artificial Sequence
  Description of Artificial Sequence: Synthetic polynucleotide
  I3RB217 half antibody
atggcctgggtgtggaccctgctgttcctgatggccgccgcccagagcatccaggccgagatcgtgctgacccagagcccaggcaccctgagcctgagcccaggcgagcgcgccaccctgagctgccgcgccagccagagcgtgagcagcagctacctggcctggtaccagcagaagccaggccaggccccacgcctgctgatctacggcgccagcagccgcgccaccggcatcccagaccgcttcagcggcagcggcagcggcaccgacttcaccctgaccatcagccgcctggagccagaggacttcgccgtgtactactgccagcaggactacggcttcccatggaccttcggccagggcaccaaggtggagatcaagcgcaccgtggccgccccaagcgtgttcatcttcccaccaagcgacgagcagctgaagagcggcaccgccagcgtggtgtgcctgctgaacaacttctacccacgcgaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagcccagtgaccaagagcttcaaccgcggcgagtgcggcggcagcgagggcaagagcagcggcagcggcagcgagagcaagagcaccgagggcaagagcagcggcagcggcagcgagagcaagagcaccggcggcagcgaggtgcagctggtgcagagcggcgccgaggtgaagaagccaggcgagagcctgaagatcagctgcaagggcagcggctacagcttcaccagctactggatcagctgggtgcgccagatgccaggcaagggcctggagtggatgggcatcatcgacccaagcgacagcgacacccgctacagcccaagcttccagggccaggtgaccatcagcgccgacaagagcatcagcaccgcctacctgcagtggagcagcctgaaggccagcgacaccgccatgtactactgcgcccgcggcgacggcagcaccgacctggactactggggccagggcaccctggtgaccgtgagcagcgccagcaccaagggcccaagcgtgttcccactggccccatgcagccgcagcaccagcgagagcaccgccgccctgggctgcctggtgaaggactacttcccagagccagtgaccgtgagctggaacagcggcgccctgaccagcggcgtgcacaccttcccagccgtgctgcagagcagcggcctgtacagcctgagcagcgtggtgaccgtgccaagcagcagcctgggcaccaagacctacacctgcaacgtggaccacaagccaagcaacaccaaggtggacaagcgcgtggagagcaagtacggcccaccatgcccaccatgcccagccccagaggccgccggcggcccaagcgtgttcctgttcccaccaaagccaaaggacaccctgatgatcagccgcaccccagaggtgacctgcgtggtggtggacgtgagccaggaggacccagaggtgcagttcaactggtacgtggacggcgtggaggtgcacaacgccaagaccaagccacgcgaggagcagttcaacagcacctaccgcgtggtgagcgtgctgaccgtgctgcaccaggactggctgaacggcaaggagtacaagtgcaaggtgagcaacaagggcctgccaagcagcatcgagaagaccatcagcaaggccaagggccagccacgcgagccacaggtgtacaccctgccaccaagccaggaggagatgaccaagaaccaggtgagcctgtggtgcctggtgaagggcttctacccaagcgacatcgccgtggagtgggagagcaacggccagccagagaacaactacaagaccaccccaccagtgctggacagcgacggcagcttcttcctgtacagccgcctgaccgtggacaagagccgctggcaggagggcaacgtgttcagctgcagcgtgatgcacgaggccctgcacaaccactacacccagaagagcctgagcctgagcctgggcaag

SEQ ID NO: 32 - protein, 713 aa, Artificial Sequence; identical to SEQ ID NO: 30
  Description of Artificial Sequence: Synthetic polypeptide
  B23B49 half antibody

SEQ ID NO: 33 - DNA, 2154 bp, Artificial Sequence
  Description of Artificial Sequence: Synthetic polynucleotide
  B23B49 half antibody
atggcctgggtgtggaccctgctgttcctgatggccgccgcccagagcatccaggccgacatcgtgatgacccagagcccagacagcctggccgtgagcctgggcgagcgcgccaccatcaactgccgcgccagccagagcgtggactacaacggcatcagctacatgcactggtaccagcagaagccaggccagccaccaaagctgctgatctacgccgccagcaacccagagagcggcgtgccagaccgcttcagcggcagcggcagcggcaccgacttcaccctgaccatcagcagcctgcaggccgaggacgtggccgtgtactactgccagcagatcatcgaggacccatggaccttcggccagggcaccaaggtggagatcaagcgcaccgtggccgccccaagcgtgttcatcttcccaccaagcgacgagcagctgaagagcggcaccgccagcgtggtgtgcctgctgaacaacttctacccacgcgaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagcccagtgaccaagagcttcaaccgcggcgagtgcggcggcagcgagggcaagagcagcggcagcggcagcgagagcaagagcaccgagggcaagagcagcggcagcggcagcgagagcaagagcaccggcggcagccagatcaccctgaaggagagcggcccaaccctggtgaagccaacccagaccctgaccctgacctgcaccttcagcggcttcagcctgagcaccagcggcatgggcgtgagctggatccgccagccaccaggcaaggccctggagtggctggcccacatctactgggacgacgacaagcgctacaacccaagcctgaagagccgcctgaccatcaccaaggacaccagcaagaaccaggtggtgctgaccatgaccaacatggacccagtggacaccgccacctactactgcgcccgcctgtacggcttcacctacggcttcgcctactggggccagggcaccctggtgaccgtgagcagcgccagcaccaagggcccaagcgtgttcccactggccccatgcagccgcagcaccagcgagagcaccgccgccctgggctgcctggtgaaggactacttcccagagccagtgaccgtgagctggaacagcggcgccctgaccagcggcgtgcacaccttcccagccgtgctgcagagcagcggcctgtacagcctgagcagcgtggtgaccgtgccaagcagcagcctgggcaccaagacctacacctgcaacgtggaccacaagccaagcaacaccaaggtggacaagcgcgtggagagcaagtacggcccaccatgcccaccatgcccagccccagaggccgccggcggcccaagcgtgttcctgttcccaccaaagccaaaggacaccctgatgatcagccgcaccccagaggtgacctgcgtggtggtggacgtgagccaggaggacccagaggtgcagttcaactggtacgtggacggcgtggaggtgcacaacgccaagaccaagccacgcgaggagcagttcaacagcacctaccgcgtggtgagcgtgctgaccgtgctgcaccaggactggctgaacggcaaggagtacaagtgcaaggtgagcaacaagggcctgccaagcagcatcgagaagaccatcagcaaggccaagggccagccacgcgagccacaggtgtacaccctgccaccaagccaggaggagatgaccaagaaccaggtgagcctgtggtgcctggtgaagggcttctacccaagcgacatcgccgtggagtgggagagcaacggccagccagagaacaactacaagaccaccccaccagtgctggacagcgacggcagcttcttcctgtacagccgcctgaccgtggacaagagccgctggcaggagggcaacgtgttcagctgcagcgtgatgcacgaggccctgcacaaccactacacccagaagagcctgagcctgagcctgggcaag

SEQ ID NO: 34 - protein, 5 aa, Artificial Sequence
  Description of Artificial Sequence: Synthetic peptide
  I3RB217 HCDR1
SYWIS

SEQ ID NO: 35 - protein, 17 aa, Artificial Sequence
  Description of Artificial Sequence: Synthetic peptide
  I3RB217 HCDR2
IIDPSDSDTRYSPSFQG

SEQ ID NO: 36 - protein, 9 aa, Artificial Sequence
  Description of Artificial Sequence: Synthetic peptide
  I3RB217 HCDR3
GDGSTDLDY

SEQ ID NO: 37 - protein, 11 aa, Artificial Sequence
  Description of Artificial Sequence: Synthetic peptide
  I3RB217 LCDR1
RASQSVSSSYL

SEQ ID NO: 38 - protein, 7 aa, Artificial Sequence
  Description of Artificial Sequence: Synthetic peptide
  I3RB217 LCDR2
GASSRAT

SEQ ID NO: 39 - protein, 9 aa, Artificial Sequence
  Description of Artificial Sequence: Synthetic peptide
  I3RB217 LCDR3
QQDYGFPWT

SEQ ID NO: 40 - protein, 118 aa, Artificial Sequence
  Description of Artificial Sequence: Synthetic polypeptide
  I3RB217 HC
EVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSS

SEQ ID NO: 41 - protein, 108 aa, Artificial Sequence
  Description of Artificial Sequence: Synthetic polypeptide
  I3RB217 LC
EIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIK

SEQ ID NO: 42 - protein, 11 aa, Artificial Sequence
  Description of Artificial Sequence: Synthetic peptide
  IGHJ1*01 HC
WGQGTLVTVSS

SEQ ID NO: 43 - protein, 10 aa, Artificial Sequence
  Description of Artificial Sequence: Synthetic peptide
  IGKJ2*01 LC
FGQGTKLEIK

SEQ ID NO: 44 - protein, 449 aa, Artificial Sequence
  Description of Artificial Sequence: Synthetic polypeptide
  Va10.2_Fc fusion
MAWVWTLLFLMAAAQSIQAQLLEQSPQFLSIQEGENLTVYCNSSSVFSSLQWYRQEPGEGPVLLVTVVTGGEVKKLKRLTFQFGDARKDSSLHITAAQPGDTGLYLCAGAGSQGNLIFGKGTKLSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 45 - protein, 11 aa, Artificial Sequence
  Description of Artificial Sequence: Synthetic peptide
GYSITSGYYWN

SEQ ID NO: 46 - protein, 120 aa, Artificial Sequence
  Description of Artificial Sequence: Synthetic polypeptide
DVQLKESGPGLVKPSQSLSVTCSVTGYSITSGYYWNWYRQFPGNKLEWMGYISYDGSNNYNPSLKNRISITRDTSKNQILLKLTYVTTEDTATYYCTRPSPGTGYAVDYWGQGTLVTVSS

SEQ ID NO: 47 - protein, 112 aa, Artificial Sequence
  Description of Artificial Sequence: Synthetic polypeptide
DIVMTQSPDSLAVSLGERATINCRSSQSLVHSNGNTYLHWYQQKPGQPPKLLIYKVSNRFSGVPDRFSGSGSGTDFTLTISSLQAEDVAVYYCSQSTHVPFTFGQGTKVEIK

SEQ ID NO: 48 - protein, 8 aa, Artificial Sequence
  Description of Artificial Sequence: Synthetic peptide
GFSLTSYG

SEQ ID NO: 49 - protein, 7 aa, Artificial Sequence
  Description of Artificial Sequence: Synthetic peptide
IWAGGGT

SEQ ID NO: 50 - protein, 13 aa, Artificial Sequence
  Description of Artificial Sequence: Synthetic peptide
ARGTFFNYDYFDY

SEQ ID NO: 51 - protein, 6 aa, Artificial Sequence
  Description of Artificial Sequence: Synthetic peptide
QDVGTD

SEQ ID NO: 52 - protein, 3 aa, Artificial Sequence
  Description of Artificial Sequence: Synthetic peptide
WAS

SEQ ID NO: 53 - protein, 9 aa, Artificial Sequence
  Description of Artificial Sequence: Synthetic peptide
QQYSRYPWT

SEQ ID NO: 54 - protein, 7 aa, Artificial Sequence
  Description of Artificial Sequence: Synthetic peptide
IWAGGNT

SEQ ID NO: 55 - protein, 13 aa, Artificial Sequence
  Description of Artificial Sequence: Synthetic peptide
ARGSFYSYLYFDY

SEQ ID NO: 56 - protein, 6 aa, Artificial Sequence
  Description of Artificial Sequence: Synthetic peptide
KSISKY

SEQ ID NO: 57 - protein, 3 aa, Artificial Sequence
  Description of Artificial Sequence: Synthetic peptide
SGS

SEQ ID NO: 58 - protein, 9 aa, Artificial Sequence
  Description of Artificial Sequence: Synthetic peptide
QQHNDYPLT

SEQ ID NO: 59 - protein, 8 aa, Artificial Sequence
  Description of Artificial Sequence: Synthetic peptide
GFSLSSYA

SEQ ID NO: 60 - protein, 14 aa, Artificial Sequence
  Description of Artificial Sequence: Synthetic peptide
ARNFFYDYDDGMDY

SEQ ID NO: 61 - protein, 11 aa, Artificial Sequence
  Description of Artificial Sequence: Synthetic peptide
QSLVHSNGNTY

SEQ ID NO: 62 - protein, 3 aa, Artificial Sequence
  Description of Artificial Sequence: Synthetic peptide
KVS

SEQ ID NO: 63 - protein, 9 aa, Artificial Sequence
  Description of Artificial Sequence: Synthetic peptide
SQSTHVPLT

SEQ ID NO: 64 - protein, 8 aa, Artificial Sequence
  Description of Artificial Sequence: Synthetic peptide
GYTFTNYG

SEQ ID NO: 65 - protein, 8 aa, Artificial Sequence
  Description of Artificial Sequence: Synthetic peptide
INTYTGEP

SEQ ID NO: 66 - protein, 12 aa, Artificial Sequence
  Description of Artificial Sequence: Synthetic peptide
ARPYFGDYAMDY

SEQ ID NO: 67 - protein, 6 aa, Artificial Sequence
  Description of Artificial Sequence: Synthetic peptide
ENIYSN

SEQ ID NO: 68 - protein, 3 aa, Artificial Sequence
  Description of Artificial Sequence: Synthetic peptide
TAT

SEQ ID NO: 69 - protein, 9 aa, Artificial Sequence
  Description of Artificial Sequence: Synthetic peptide
QHFWGNPWT

SEQ ID NO: 70 - protein, 8 aa, Artificial Sequence
  Description of Artificial Sequence: Synthetic peptide
GFSLTSYA

SEQ ID NO: 71 - protein, 14 aa, Artificial Sequence
  Description of Artificial Sequence: Synthetic peptide
ARNPFYDYDEGLDY

SEQ ID NO: 72 - protein, 3 aa, Artificial Sequence
  Description of Artificial Sequence: Synthetic peptide
KVS

SEQ ID NO: 73 - protein, 9 aa, Artificial Sequence
  Description of Artificial Sequence: Synthetic peptide
SQSTHVPWT

SEQ ID NO: 74 - protein, 7 aa, Artificial Sequence
  Description of Artificial Sequence: Synthetic peptide
IWAGGNT

SEQ ID NO: 75 - protein, 13 aa, Artificial Sequence
  Description of Artificial Sequence: Synthetic peptide
ARGSFYDYLYFDY

SEQ ID NO: 76 - protein, 9 aa, Artificial Sequence
  Description of Artificial Sequence: Synthetic peptide
QQHNEYPLT

SEQ ID NO: 77 - protein, 119 aa, Artificial Sequence
  Description of Artificial Sequence: Synthetic polypeptide
QVQLKESGPGLVAPSQSLSITCTVSGFSLTSYGVHWVRQPPGKGLEWLGIIWAGGGTNYNSALMSRLSITKDNSKSQVSLKMNSLQTDDTAMYYCARGTFFNYDYFDYWGQGTTLTVSS

SEQ ID NO: 78 - protein, 107 aa, Artificial Sequence
  Description of Artificial Sequence: Synthetic polypeptide
DIVMTQSQKFMSTSVGDRVSITCKASQDVGTDVAWYQQKPGQSPKLMIYWASTRHTGVPDRFTGSGSGTDFTLTISNVQSEDLADYFCQQYSRYPWTFGAGTKLELK

SEQ ID NO: 79 - protein, 119 aa, Artificial Sequence
  Description of Artificial Sequence: Synthetic polypeptide
QVQLKESGPVLVAPSQSLSITCTVSGFSLTSYGVHWVRQPPGKGLEWLGIIWAGGNTNSNSALMSRLSISKDNSKSQVFLKMNSLQTDDTAMYYCARGSFYSYLYFDYWGQGTTLTVSS

SEQ ID NO: 80 - protein, 107 aa, Artificial Sequence
  Description of Artificial Sequence: Synthetic polypeptide
DIVMTQSPSYLAASPGETITINCRASKSISKYLAWYQEKPGKTNKLLIYSGSTLQSGIPSRFSGSGSGTDFTLTISSLEPEDFAMYYCQQHNDYPLTFGAGTKLELK

SEQ ID NO: 81 - protein, 120 aa, Artificial Sequence
  Description of Artificial Sequence: Synthetic polypeptide
DVQLQESGPGLVAPSQSLSITCTVSGFSLSSYAISWVRQPPGKGLEWLGVIWAGGGTNYNSALKSRLSISKDNSKSQVFLKMKSLQTDDTARYYCARNFFYDYDDGMDYWGQGTTVTVSS

SEQ ID NO: 82 - protein, 112 aa, Artificial Sequence
  Description of Artificial Sequence: Synthetic polypeptide
NTQMNQTPLSLPVSLGDQASISCRSSQSLVHSNGNTYLHWYLQKPGQSPKLLIYKVSNRFSGVPDRFSGSGSGTDFTLKINRVEAEDLGVYFCSQSTHVPLTFGAGTRLEIK

SEQ ID NO: 83 - protein, 119 aa, Artificial Sequence
  Description of Artificial Sequence: Synthetic polypeptide
QIQLVQSGPELKKPGETVKISCKASGYTFTNYGMNWVKQAPGKGLKWMGWINTYTGEPTYADDFKGRFAFSLETSASTAYLQINNLKNEDMATYFCARPYFGDYAMDYWGQGTLVTVSA

SEQ ID NO: 84 - protein, 107 aa, Artificial Sequence
  Description of Artificial Sequence: Synthetic polypeptide
DVQMIQSPASLSVSVGETVTITCRASENIYSNLAWYQQKQGKSPQVLVYTATNLADGVPSRFSGSGSGTQYSLKINSLQSEDFGSYYCQHFWGNPWTFGGGTKLEIK

SEQ ID NO: 85 - protein, 120 aa, Artificial Sequence
  Description of Artificial Sequence: Synthetic polypeptide
QVQLQQSGPGLVAPSQSLSITCTVSGFSLTSYAISWIRQPPGKGLEWLGIIWAGGGTNYNSALKSRLSISKDNSKSQVFLKMNSLQIDDTARYYCARNPFYDYDEGLDYWGQGTTLTVSS

SEQ ID NO: 86 - protein, 112 aa, Artificial Sequence
  Description of Artificial Sequence: Synthetic polypeptide
DIVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 87 - protein, 119 aa, Artificial Sequence
  Description of Artificial Sequence: Synthetic polypeptide
QVQLKESGPVLVAPSQSLSITCTVSGFSLTSYGVHWIRQPPGKGLEWLGVIWAGGNTNYNSTLMSRLSISKDNSKSQVFLKMNSLQTDDTAMYYCARGSFYDYLYFDYWGQGTTLTVSS

SEQ ID NO: 88 - protein, 107 aa, Artificial Sequence
  Description of Artificial Sequence: Synthetic polypeptide
DIQMTQSPSYLAASPGETITINCRASKSISKYLAWYQEKPGKTNELLIYSGSTLQSGIPSRFSGSGSGTDFTLTISSLEPEDFAMYYCQQHNEYPLTFGGGTKLEIK

SEQ ID NO: 89 - protein, 8 aa, Artificial Sequence
  Description of Artificial Sequence: Synthetic peptide
GFTFSSYA

SEQ ID NO: 90 - protein, 8 aa, Artificial Sequence
  Description of Artificial Sequence: Synthetic peptide
ISGSGGST

SEQ ID NO: 91 - protein, 16 aa, Artificial Sequence
  Description of Artificial Sequence: Synthetic peptide
AKDEGYSSGHYYGMDV

SEQ ID NO: 92 - protein, 7 aa, Artificial Sequence
  Description of Artificial Sequence: Synthetic peptide
QSISSSF

SEQ ID NO: 93 - protein, 3 aa, Artificial Sequence
  Description of Artificial Sequence: Synthetic peptide
GAS

SEQ ID NO: 94 - protein, 10 aa, Artificial Sequence
  Description of Artificial Sequence: Synthetic peptide
QHYGSSPMYT

SEQ ID NO: 95 - protein, 123 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDEGYSSGHYYGMDVWGQGTTVTVSS

SEQ ID NO: 96 - protein, 109 aa, Artificial Sequence
  Description of Artificial Sequence: Synthetic polypeptide
EIVLTQSPGTLSLSPGERATLSCRASQSISSSFLTWYQQKPGQAPRLLIYGASSRATGIPDRFSGGGSGTDFTLTISRLEPEDFAVYYCQHYGSSPMYTFGQGTKLEIK

SEQ ID NO: 97 - protein, 11 aa, Artificial Sequence
  Description of Artificial Sequence: Synthetic peptide
GYSITSGYFWN

SEQ ID NO: 98 - protein, 16 aa, Artificial Sequence
  Description of Artificial Sequence: Synthetic peptide
YISYDGSNNYNPSLKN

SEQ ID NO: 99 - protein, 11 aa, Artificial Sequence
  Description of Artificial Sequence: Synthetic peptide
PSPGTGYAVDY

SEQ ID NO: 100 - protein, 16 aa, Artificial Sequence
  Description of Artificial Sequence: Synthetic peptide
RSSQSLVHSNGNTYLH

SEQ ID NO: 101 - protein, 7 aa, Artificial Sequence
  Description of Artificial Sequence: Synthetic peptide
KVSNRFS

SEQ ID NO: 102 - protein, 9 aa, Artificial Sequence
  Description of Artificial Sequence: Synthetic peptide
SQSTHVPFT

SEQ ID NO: 103 - protein, 9 aa, Artificial Sequence
  Description of Artificial Sequence: Synthetic peptide
GYSITSGYF

SEQ ID NO: 104 - protein, 7 aa, Artificial Sequence
  Description of Artificial Sequence: Synthetic peptide
ISYDGSN

SEQ ID NO: 105 - protein, 13 aa, Artificial Sequence
  Description of Artificial Sequence: Synthetic peptide
ASPSPGTGYAVDY

SEQ ID NO: 106 - protein, 11 aa, Artificial Sequence
  Description of Artificial Sequence: Synthetic peptide
QSLVHSNGNTY

SEQ ID NO: 107 - protein, 3 aa, Artificial Sequence
  Description of Artificial Sequence: Synthetic peptide
KVS

SEQ ID NO: 108 - protein, 9 aa, Artificial Sequence
  Description of Artificial Sequence: Synthetic peptide
SQSTHVPFT

SEQ ID NO: 109 - protein, 5 aa, Artificial Sequence
  Description of Artificial Sequence: Synthetic peptide
GYFWN

SEQ ID NO: 110 - protein, 16 aa, Artificial Sequence
  Description of Artificial Sequence: Synthetic peptide
YISYDGSNNYNPSLKN

SEQ ID NO: 111 - protein, 11 aa, Artificial Sequence
  Description of Artificial Sequence: Synthetic peptide
PSPGTGYAVDY

SEQ ID NO: 112 - protein, 16 aa, Artificial Sequence
  Description of Artificial Sequence: Synthetic peptide
RSSQSLVHSNGNTYLH

SEQ ID NO: 113 - protein, 7 aa, Artificial Sequence
  Description of Artificial Sequence: Synthetic peptide
KVSNRFS

SEQ ID NO: 114 - protein, 9 aa, Artificial Sequence
  Description of Artificial Sequence: Synthetic peptide
SQSTHVPFT

SEQ ID NO: 115 - protein, 8 aa, Artificial Sequence
  Description of Artificial Sequence: Synthetic peptide
GYSITSGY

SEQ ID NO: 116 - protein, 3 aa, Artificial Sequence
  Description of Artificial Sequence: Synthetic peptide
YDG

SEQ ID NO: 117 - protein, 9 aa, Artificial Sequence
  Description of Artificial Sequence: Synthetic peptide
SPGTGYAVD

SEQ ID NO: 118 - protein, 12 aa, Artificial Sequence
  Description of Artificial Sequence: Synthetic peptide
SQSLVHSNGNTY

SEQ ID NO: 119 - protein, 3 aa, Artificial Sequence
  Description of Artificial Sequence: Synthetic peptide
KVS

SEQ ID NO: 120 - protein, 6 aa, Artificial Sequence
  Description of Artificial Sequence: Synthetic peptide
STHVPF

SEQ ID NO: 121-126 - skipped (6 entries)

SEQ ID NO: 127 - protein, 7 aa, Artificial Sequence
  Description of Artificial Sequence: Synthetic peptide
TSGYFWN

SEQ ID NO: 128 - protein, 12 aa, Artificial Sequence
  Description of Artificial Sequence: Synthetic peptide
WMGYISYDGSNN

SEQ ID NO: 129 - protein, 12 aa, Artificial Sequence
  Description of Artificial Sequence: Synthetic peptide
ASPSPGTGYAVD

SEQ ID NO: 130 - protein, 12 aa, Artificial Sequence
  Description of Artificial Sequence: Synthetic peptide
VHSNGNTYLHWY

SEQ ID NO: 131 - protein, 10 aa, Artificial Sequence
  Description of Artificial Sequence: Synthetic peptide
FLIYKVSNRF

SEQ ID NO: 132 - protein, 8 aa, Artificial Sequence
  Description of Artificial Sequence: Synthetic peptide
SQSTHVPF

SEQ ID NO: 133 - protein, 11 aa, Artificial Sequence
  Description of Artificial Sequence: Synthetic peptide
GYSITSGYFWN

SEQ ID NO: 134 - protein, 9 aa, Artificial Sequence
  Description of Artificial Sequence: Synthetic peptide
YISYDGSNN

SEQ ID NO: 135 - protein, 11 aa, Artificial Sequence
  Description of Artificial Sequence: Synthetic peptide
PSPGTGYAVDY

SEQ ID NO: 136 - protein, 16 aa, Artificial Sequence
  Description of Artificial Sequence: Synthetic peptide
RSSQSLVHSNGNTYLH

SEQ ID NO: 137 - protein, 7 aa, Artificial Sequence
  Description of Artificial Sequence: Synthetic peptide
KVSNRFS

SEQ ID NO: 138 - protein, 9 aa, Artificial Sequence
  Description of Artificial Sequence: Synthetic peptide
SQSTHVPFT

SEQ ID NO: 139 - protein, 11 aa, Artificial Sequence
  Description of Artificial Sequence: Synthetic peptide
GYSITSGYFWN

SEQ ID NO: 140 - protein, 16 aa, Artificial Sequence
  Description of Artificial Sequence: Synthetic peptide
YISYDGSNNYADSVKG

SEQ ID NO: 141 - protein, 11 aa, Artificial Sequence
  Description of Artificial Sequence: Synthetic peptide
PSPGTGYAVDY

SEQ ID NO: 142 - protein, 16 aa, Artificial Sequence
  Description of Artificial Sequence: Synthetic peptide
RSSQSLVHSNGNTYLH

SEQ ID NO: 143 - protein, 7 aa, Artificial Sequence
  Description of Artificial Sequence: Synthetic peptide
KVSNRFS

SEQ ID NO: 144 - protein, 9 aa, Artificial Sequence
  Description of Artificial Sequence: Synthetic peptide
SQSTHVPFT

SEQ ID NO: 145 - protein, 9 aa, Artificial Sequence
  Description of Artificial Sequence: Synthetic peptide
GYSITSGYF

SEQ ID NO: 146 - protein, 7 aa, Artificial Sequence
  Description of Artificial Sequence: Synthetic peptide
ISYDGSN

SEQ ID NO: 147 - protein, 13 aa, Artificial Sequence
  Description of Artificial Sequence: Synthetic peptide
AKPSPGTGYAVDY

SEQ ID NO: 148 - protein, 11 aa, Artificial Sequence
  Description of Artificial Sequence: Synthetic peptide
QSLVHSNGNTY

SEQ ID NO: 149 - protein, 3 aa, Artificial Sequence
  Description of Artificial Sequence: Synthetic peptide
KVS

SEQ ID NO: 150 - protein, 9 aa, Artificial Sequence
  Description of Artificial Sequence: Synthetic peptide
SQSTHVPFT

SEQ ID NO: 151 - protein, 5 aa, Artificial Sequence
  Description of Artificial Sequence: Synthetic peptide
GYFWN

SEQ ID NO: 152 - protein, 16 aa, Artificial Sequence
  Description of Artificial Sequence: Synthetic peptide
YISYDGSNNYADSVKG

SEQ ID NO: 153 - protein, 11 aa, Artificial Sequence
  Description of Artificial Sequence: Synthetic peptide
PSPGTGYAVDY

SEQ ID NO: 154 - protein, 16 aa, Artificial Sequence
  Description of Artificial Sequence: Synthetic peptide
RSSQSLVHSNGNTYLH

SEQ ID NO: 155 - protein, 7 aa, Artificial Sequence
  Description of Artificial Sequence: Synthetic peptide
KVSNRFS

SEQ ID NO: 156 - protein, 9 aa, Artificial Sequence
  Description of Artificial Sequence: Synthetic peptide
SQSTHVPFT

SEQ ID NO: 157 - protein, 8 aa, Artificial Sequence
  Description of Artificial Sequence: Synthetic peptide
GYSITSGY

SEQ ID NO: 158 - protein, 3 aa, Artificial Sequence
  Description of Artificial Sequence: Synthetic peptide
YDG

SEQ ID NO: 159 - protein, 9 aa, Artificial Sequence
  Description of Artificial Sequence: Synthetic peptide
SPGTGYAVD

SEQ ID NO: 160 - protein, 12 aa, Artificial Sequence
  Description of Artificial Sequence: Synthetic peptide
SQSLVHSNGNTY

SEQ ID NO: 161 - protein, 3 aa, Artificial Sequence
  Description of Artificial Sequence: Synthetic peptide
KVS

SEQ ID NO: 162 - protein, 6 aa, Artificial Sequence
  Description of Artificial Sequence: Synthetic peptide
STHVPF

SEQ ID NO: 163-168 - skipped (6 entries)

SEQ ID NO: 169 - protein, 7 aa, Artificial Sequence
  Description of Artificial Sequence: Synthetic peptide
TSGYFWN

SEQ ID NO: 170 - protein, 12 aa, Artificial Sequence
  Description of Artificial Sequence: Synthetic peptide
WVSYISYDGSNN

SEQ ID NO: 171 - protein, 12 aa, Artificial Sequence
  Description of Artificial Sequence: Synthetic peptide
AKPSPGTGYAVD

SEQ ID NO: 172 - protein, 12 aa, Artificial Sequence
  Description of Artificial Sequence: Synthetic peptide
VHSNGNTYLHWY

SEQ ID NO: 173 - protein, 10 aa, Artificial Sequence
  Description of Artificial Sequence: Synthetic peptide
LLIYKVSNRF

SEQ ID NO: 174 - protein, 8 aa, Artificial Sequence
  Description of Artificial Sequence: Synthetic peptide
SQSTHVPF

SEQ ID NO: 175 - protein, 11 aa, Artificial Sequence
  Description of Artificial Sequence: Synthetic peptide
GYSITSGYFWN

SEQ ID NO: 176 - protein, 9 aa, Artificial Sequence
  Description of Artificial Sequence: Synthetic peptide
YISYDGSNN

SEQ ID NO: 177 - protein, 11 aa, Artificial Sequence
  Description of Artificial Sequence: Synthetic peptide
PSPGTGYAVDY

SEQ ID NO: 178 - protein, 16 aa, Artificial Sequence
  Description of Artificial Sequence: Synthetic peptide
RSSQSLVHSNGNTYLH

SEQ ID NO: 179 - protein, 7 aa, Artificial Sequence
  Description of Artificial Sequence: Synthetic peptide
KVSNRFS

SEQ ID NO: 180 - protein, 9 aa, Artificial Sequence
  Description of Artificial Sequence: Synthetic peptide
SQSTHVPFT

SEQ ID NO: 181 - protein, 11 aa, Artificial Sequence
  Description of Artificial Sequence: Synthetic peptide
GYSITSGYFWN

SEQ ID NO: 182 - protein, 16 aa, Artificial Sequence
  Description of Artificial Sequence: Synthetic peptide
YISYDGSNNYADSVKG

SEQ ID NO: 183 - protein, 11 aa, Artificial Sequence
  Description of Artificial Sequence: Synthetic peptide
PSPGTGYAVDY

SEQ ID NO: 184 - protein, 16 aa, Artificial Sequence
  Description of Artificial Sequence: Synthetic peptide
RSSQSLVHSNGNTYLH

SEQ ID NO: 185 - protein, 7 aa, Artificial Sequence
  Description of Artificial Sequence: Synthetic peptide
KVSNRFS

SEQ ID NO: 186 - protein, 9 aa, Artificial Sequence
  Description of Artificial Sequence: Synthetic peptide
SQSTHVPFT

SEQ ID NO: 187 - protein, 9 aa, Artificial Sequence
  Description of Artificial Sequence: Synthetic peptide
GYSITSGYF

SEQ ID NO: 188 - protein, 7 aa, Artificial Sequence
  Description of Artificial Sequence: Synthetic peptide
ISYDGSN

SEQ ID NO: 189 - protein, 13 aa, Artificial Sequence
  Description of Artificial Sequence: Synthetic peptide
ASPSPGTGYAVDY

SEQ ID NO: 190 - protein, 11 aa, Artificial Sequence
  Description of Artificial Sequence: Synthetic peptide
QSLVHSNGNTY

SEQ ID NO: 191 - protein, 3 aa, Artificial Sequence
  Description of Artificial Sequence: Synthetic peptide
KVS

SEQ ID NO: 192 - protein, 9 aa, Artificial Sequence
  Description of Artificial Sequence: Synthetic peptide
SQSTHVPFT

SEQ ID NO: 193 - protein, 5 aa, Artificial Sequence
  Description of Artificial Sequence: Synthetic peptide
GYFWN

SEQ ID NO: 194 - protein, 16 aa, Artificial Sequence
  Description of Artificial Sequence: Synthetic peptide
YISYDGSNNYADSVKG

SEQ ID NO: 195 - protein, 11 aa, Artificial Sequence
  Description of Artificial Sequence: Synthetic peptide
PSPGTGYAVDY

SEQ ID NO: 196 - protein, 16 aa, Artificial Sequence
  Description of Artificial Sequence: Synthetic peptide
RSSQSLVHSNGNTYLH

SEQ ID NO: 197 - protein, 7 aa, Artificial Sequence
  Description of Artificial Sequence: Synthetic peptide
KVSNRFS

SEQ ID NO: 198 - protein, 9 aa, Artificial Sequence
  Description of Artificial Sequence: Synthetic peptide
SQSTHVPFT

SEQ ID NO: 199 - protein, 8 aa, Artificial Sequence
  Description of Artificial Sequence: Synthetic peptide
GYSITSGY

SEQ ID NO: 200 - protein, 3 aa, Artificial Sequence
  Description of Artificial Sequence: Synthetic peptide
YDG

SEQ ID NO: 201 - protein, 9 aa, Artificial Sequence
  Description of Artificial Sequence: Synthetic peptide
SPGTGYAVD

SEQ ID NO: 202 - protein, 12 aa, Artificial Sequence
  Description of Artificial Sequence: Synthetic peptide
SQSLVHSNGNTY

SEQ ID NO: 203 - protein, 3 aa, Artificial Sequence
  Description of Artificial Sequence: Synthetic peptide
KVS

SEQ ID NO: 204 - protein, 6 aa, Artificial Sequence
  Description of Artificial Sequence: Synthetic peptide
STHVPF

SEQ ID NO: 205-210 - skipped (6 entries)

SEQ ID NO: 211 - protein, 7 aa, Artificial Sequence
  Description of Artificial Sequence: Synthetic peptide
TSGYFWN

SEQ ID NO: 212 - protein, 12 aa, Artificial Sequence
  Description of Artificial Sequence: Synthetic peptide
WVSYISYDGSNN

SEQ ID NO: 213 - protein, 12 aa, Artificial Sequence
  Description of Artificial Sequence: Synthetic peptide
ASPSPGTGYAVD

SEQ ID NO: 214 - protein, 12 aa, Artificial Sequence
  Description of Artificial Sequence: Synthetic peptide
VHSNGNTYLHWY

SEQ ID NO: 215 - protein, 10 aa, Artificial Sequence
  Description of Artificial Sequence: Synthetic peptide
FLIYKVSNRF

SEQ ID NO: 216 - protein, 8 aa, Artificial Sequence
  Description of Artificial Sequence: Synthetic peptide
SQSTHVPF

SEQ ID NO: 217 - protein, 11 aa, Artificial Sequence
  Description of Artificial Sequence: Synthetic peptide
GYSITSGYFWN

SEQ ID NO: 218 - protein, 9 aa, Artificial Sequence
  Description of Artificial Sequence: Synthetic peptide
YISYDGSNN

SEQ ID NO: 219 - protein, 11 aa, Artificial Sequence
  Description of Artificial Sequence: Synthetic peptide
PSPGTGYAVDY

SEQ ID NO: 220 - protein, 16 aa, Artificial Sequence
  Description of Artificial Sequence: Synthetic peptide
RSSQSLVHSNGNTYLH

SEQ ID NO: 221 - protein, 7 aa, Artificial Sequence
  Description of Artificial Sequence: Synthetic peptide
KVSNRFS

SEQ ID NO: 222 - protein, 9 aa, Artificial Sequence
  Description of Artificial Sequence: Synthetic peptide
SQSTHVPFT

SEQ ID NO: 223 - protein, 11 aa, Artificial Sequence
  Description of Artificial Sequence: Synthetic peptide
GYSITSGYFWN

SEQ ID NO: 224 - protein, 16 aa, Artificial Sequence
  Description of Artificial Sequence: Synthetic peptide
YISYDGSNNYNPSLKS

SEQ ID NO: 225 - protein, 11 aa, Artificial Sequence
  Description of Artificial Sequence: Synthetic peptide
PSPGTGYAVDY

SEQ ID NO: 226 - protein, 16 aa, Artificial Sequence
  Description of Artificial Sequence: Synthetic peptide
RSSQSLVHSNGNTYLH

SEQ ID NO: 227 - protein, 7 aa, Artificial Sequence
  Description of Artificial Sequence: Synthetic peptide
KVSNRFS

SEQ ID NO: 228 - protein, 9 aa, Artificial Sequence
  Description of Artificial Sequence: Synthetic peptide
SQSTHVPFT

SEQ ID NO: 229 - protein, 9 aa, Artificial Sequence
  Description of Artificial Sequence: Synthetic peptide
GYSITSGYF

SEQ ID NO: 230 - protein, 7 aa, Artificial Sequence
  Description of Artificial Sequence: Synthetic peptide
ISYDGSN

SEQ ID NO: 231 - protein, 13 aa, Artificial Sequence
  Description of Artificial Sequence: Synthetic peptide
ASPSPGTGYAVDY

SEQ ID NO: 232 - protein, 11 aa, Artificial Sequence
  Description of Artificial Sequence: Synthetic peptide
QSLVHSNGNTY

SEQ ID NO: 233 - protein, 3 aa, Artificial Sequence
  Description of Artificial Sequence: Synthetic peptide
KVS

SEQ ID NO: 234 - protein, 9 aa, Artificial Sequence
  Description of Artificial Sequence: Synthetic peptide
SQSTHVPFT

SEQ ID NO: 235 - protein, 5 aa, Artificial Sequence
  Description of Artificial Sequence: Synthetic peptide
GYFWN

SEQ ID NO: 236 - protein, 16 aa, Artificial Sequence
  Description of Artificial Sequence: Synthetic peptide
YISYDGSNNYNPSLKS

SEQ ID NO: 237 - protein, 11 aa, Artificial Sequence
  Description of Artificial Sequence: Synthetic peptide
PSPGTGYAVDY

SEQ ID NO: 238 - protein, 16 aa, Artificial Sequence
  Description of Artificial Sequence: Synthetic peptide
RSSQSLVHSNGNTYLH

SEQ ID NO: 239 - protein, 7 aa, Artificial Sequence
  Description of Artificial Sequence: Synthetic peptide
KVSNRFS

SEQ ID NO: 240 - protein, 9 aa, Artificial Sequence
  Description of Artificial Sequence: Synthetic peptide
SQSTHVPFT

SEQ ID NO: 241 - protein, 8 aa, Artificial Sequence
  Description of Artificial Sequence: Synthetic peptide
GYSITSGY

SEQ ID NO: 242 - protein, 3 aa, Artificial Sequence
  Description of Artificial Sequence: Synthetic peptide
YDG

SEQ ID NO: 243 - protein, 9 aa, Artificial Sequence
  Description of Artificial Sequence: Synthetic peptide
SPGTGYAVD

SEQ ID NO: 244 - protein, 12 aa, Artificial Sequence
  Description of Artificial Sequence: Synthetic peptide
SQSLVHSNGNTY

SEQ ID NO: 245 - protein, 3 aa, Artificial Sequence
  Description of Artificial Sequence: Synthetic peptide
KVS

SEQ ID NO: 246 - protein, 6 aa, Artificial Sequence
  Description of Artificial Sequence: Synthetic peptide
STHVPF

SEQ ID NO: 247-252 - skipped (6 entries)

SEQ ID NO: 253 - protein, 7 aa, Artificial Sequence
  Description of Artificial Sequence: Synthetic peptide
TSGYFWN

SEQ ID NO: 254 - protein, 12 aa, Artificial Sequence
  Description of Artificial Sequence: Synthetic peptide
WIGYISYDGSNN

SEQ ID NO: 255 - protein, 12 aa, Artificial Sequence
  Description of Artificial Sequence: Synthetic peptide
ASPSPGTGYAVD

SEQ ID NO: 256 - protein, 12 aa, Artificial Sequence
  Description of Artificial Sequence: Synthetic peptide
VHSNGNTYLHWF

SEQ ID NO: 257 - protein, 10 aa, Artificial Sequence
  Description of Artificial Sequence: Synthetic peptide
FLIYKVSNRF

SEQ ID NO: 258 - protein, 8 aa, Artificial Sequence
  Description of Artificial Sequence: Synthetic peptide
SQSTHVPF

SEQ ID NO: 259 - protein, 11 aa, Artificial Sequence
  Description of Artificial Sequence: Synthetic peptide
GYSITSGYFWN

SEQ ID NO: 260 - protein, 9 aa, Artificial Sequence
  Description of Artificial Sequence: Synthetic peptide
YISYDGSNN

SEQ ID NO: 261 - protein, 11 aa, Artificial Sequence
  Description of Artificial Sequence: Synthetic peptide
PSPGTGYAVDY

SEQ ID NO: 262 - protein, 16 aa, Artificial Sequence
  Description of Artificial Sequence: Synthetic peptide
RSSQSLVHSNGNTYLH

SEQ ID NO: 263 - protein, 7 aa, Artificial Sequence
  Description of Artificial Sequence: Synthetic peptide
KVSNRFS

SEQ ID NO: 264 - protein, 9 aa, Artificial Sequence
  Description of Artificial Sequence: Synthetic peptide
SQSTHVPFT

SEQ ID NO: 265 - protein, 11 aa, Artificial Sequence
  Description of Artificial Sequence: Synthetic peptide
GYSITSGYYWN

SEQ ID NO: 266 - protein, 16 aa, Artificial Sequence
  Description of Artificial Sequence: Synthetic peptide
YISYDGSNNYNPSLKN

SEQ ID NO: 267 - protein, 11 aa, Artificial Sequence
  Description of Artificial Sequence: Synthetic peptide
PSPGTGYAVDY

SEQ ID NO: 268 - protein, 16 aa, Artificial Sequence
  Description of Artificial Sequence: Synthetic peptide
RSSQSLVHSNGNTYLH

SEQ ID NO: 269 - protein, 7 aa, Artificial Sequence
  Description of Artificial Sequence: Synthetic peptide
KVSNRFS

SEQ ID NO: 270 - protein, 9 aa, Artificial Sequence
  Description of Artificial Sequence: Synthetic peptide
SQSTHVPFT

SEQ ID NO: 271 - protein, 9 aa, Artificial Sequence
  Description of Artificial Sequence: Synthetic peptide
GYSITSGYY

SEQ ID NO: 272 - protein, 7 aa, Artificial Sequence
  Description of Artificial Sequence: Synthetic peptide
ISYDGSN

SEQ ID NO: 273 - protein, 13 aa, Artificial Sequence
  Description of Artificial Sequence: Synthetic peptide
TRPSPGTGYAVDY

SEQ ID NO: 274 - protein, 11 aa, Artificial Sequence
  Description of Artificial Sequence: Synthetic peptide
QSLVHSNGNTY

SEQ ID NO: 275 - protein, 3 aa, Artificial Sequence
  Description of Artificial Sequence: Synthetic peptide
KVS

SEQ ID NO: 276 - protein, 9 aa, Artificial Sequence
  Description of Artificial Sequence: Synthetic peptide
SQSTHVPFT

SEQ ID NO: 277 - protein, 5 aa, Artificial Sequence
  Description of Artificial Sequence: Synthetic peptide
GYYWN

SEQ ID NO: 278 - protein, 16 aa, Artificial Sequence
  Description of Artificial Sequence: Synthetic peptide
YISYDGSNNYNPSLKN

SEQ ID NO: 279 - protein, 11 aa, Artificial Sequence
  Description of Artificial Sequence: Synthetic peptide
PSPGTGYAVDY

SEQ ID NO: 280 - protein, 16 aa, Artificial Sequence
  Description of Artificial Sequence: Synthetic peptide
RSSQSLVHSNGNTYLH

SEQ ID NO: 281 - protein, 7 aa, Artificial Sequence
  Description of Artificial Sequence: Synthetic peptide
KVSNRFS

SEQ ID NO: 282 - protein, 9 aa, Artificial Sequence
  Description of Artificial Sequence: Synthetic peptide
SQSTHVPFT

SEQ ID NO: 283 - protein, 8 aa, Artificial Sequence
  Description of Artificial Sequence: Synthetic peptide
GYSITSGY

SEQ ID NO: 284 - protein, 3 aa, Artificial Sequence
  Description of Artificial Sequence: Synthetic peptide
YDG

SEQ ID NO: 285 - protein, 9 aa, Artificial Sequence
  Description of Artificial Sequence: Synthetic peptide
SPGTGYAVD

SEQ ID NO: 286 - protein, 12 aa, Artificial Sequence
  Description of Artificial Sequence: Synthetic peptide
SQSLVHSNGNTY

SEQ ID NO: 287 - protein, 3 aa, Artificial Sequence
  Description of Artificial Sequence: Synthetic peptide
KVS

SEQ ID NO: 288 - protein, 6 aa, Artificial Sequence
  Description of Artificial Sequence: Synthetic peptide
STHVPF

SEQ ID NO: 289-294 - skipped (6 entries)

SEQ ID NO: 295 - protein, 7 aa, Artificial Sequence
  Description of Artificial Sequence: Synthetic peptide
TSGYYWN

SEQ ID NO: 296 - protein, 12 aa, Artificial Sequence
  Description of Artificial Sequence: Synthetic peptide
WMGYISYDGSNN

SEQ ID NO: 297 - protein, 12 aa, Artificial Sequence
  Description of Artificial Sequence: Synthetic peptide
TRPSPGTGYAVD

SEQ ID NO: 298 - protein, 12 aa, Artificial Sequence
  Description of Artificial Sequence: Synthetic peptide
VHSNGNTYLHWY

SEQ ID NO: 299 - protein, 10 aa, Artificial Sequence
  Description of Artificial Sequence: Synthetic peptide
LLIYKVSNRF

SEQ ID NO: 300 - protein, 8 aa, Artificial Sequence
  Description of Artificial Sequence: Synthetic peptide
SQSTHVPF

SEQ ID NO: 301 - protein, 11 aa, Artificial Sequence
  Description of Artificial Sequence: Synthetic peptide
GYSITSGYYWN

SEQ ID NO: 302 - protein, 9 aa, Artificial Sequence
  Description of Artificial Sequence: Synthetic peptide
YISYDGSNN

SEQ ID NO: 303 - protein, 11 aa, Artificial Sequence
  Description of Artificial Sequence: Synthetic peptide
PSPGTGYAVDY

SEQ ID NO: 304 - protein, 16 aa, Artificial Sequence
  Description of Artificial Sequence: Synthetic peptide
RSSQSLVHSNGNTYLH

SEQ ID NO: 305 - protein, 7 aa, Artificial Sequence
  Description of Artificial Sequence: Synthetic peptide
KVSNRFS

SEQ ID NO: 306 - protein, 9 aa, Artificial Sequence
  Description of Artificial Sequence: Synthetic peptide
SQSTHVPFT

SEQ ID NO: 307 - protein, 10 aa, Artificial Sequence
  Description of Artificial Sequence: Synthetic peptide
GFSLTSYGVH

SEQ ID NO: 308 - protein, 16 aa, Artificial Sequence
  Description of Artificial Sequence: Synthetic peptide
IIWAGGGTNYNSALMS

SEQ ID NO: 309 - protein, 11 aa, Artificial Sequence
  Description of Artificial Sequence: Synthetic peptide
GTFFNYDYFDY

SEQ ID NO: 310 - protein, 11 aa, Artificial Sequence
  Description of Artificial Sequence: Synthetic peptide
KASQDVGTDVA

SEQ ID NO: 311 - protein, 7 aa, Artificial Sequence
  Description of Artificial Sequence: Synthetic peptide
WASTRHT

SEQ ID NO: 312 - protein, 9 aa, Artificial Sequence
  Description of Artificial Sequence: Synthetic peptide
QQYSRYPWT

SEQ ID NO: 313 - protein, 8 aa, Artificial Sequence
  Description of Artificial Sequence: Synthetic peptide
GFSLTSYG

SEQ ID NO: 314 - protein, 7 aa, Artificial Sequence
  Description of Artificial Sequence: Synthetic peptide
IWAGGGT

SEQ ID NO: 315 - protein, 13 aa, Artificial Sequence
  Description of Artificial Sequence: Synthetic peptide
ARGTFFNYDYFDY

SEQ ID NO: 316 - protein, 6 aa, Artificial Sequence
  Description of Artificial Sequence: Synthetic peptide
QDVGTD

SEQ ID NO: 317 - protein, 3 aa, Artificial Sequence
  Description of Artificial Sequence: Synthetic peptide
WAS

SEQ ID NO: 318 - protein, 9 aa, Artificial Sequence
  Description of Artificial Sequence: Synthetic peptide
QQYSRYPWT

SEQ ID NO: 319 - protein, 5 aa, Artificial Sequence
  Description of Artificial Sequence: Synthetic peptide
SYGVH

SEQ ID NO: 320 - protein, 16 aa, Artificial Sequence
  Description of Artificial Sequence: Synthetic peptide
IIWAGGGTNYNSALMS

SEQ ID NO: 321 - protein, 11 aa, Artificial Sequence
  Description of Artificial Sequence: Synthetic peptide
GTFFNYDYFDY

SEQ ID NO: 322 - protein, 11 aa, Artificial Sequence
  Description of Artificial Sequence: Synthetic peptide
KASQDVGTDVA

SEQ ID NO: 323 - protein, 7 aa, Artificial Sequence
  Description of Artificial Sequence: Synthetic peptide
WASTRHT

SEQ ID NO: 324 - protein, 9 aa, Artificial Sequence
  Description of Artificial Sequence: Synthetic peptide
QQYSRYPWT

SEQ ID NO: 325 - protein, 7 aa, Artificial Sequence
  Description of Artificial Sequence: Synthetic peptide
GFSLTSY

SEQ ID NO: 326 - protein, 3 aa, Artificial Sequence
  Description of Artificial Sequence: Synthetic peptide
AGG

SEQ ID NO: 327 - protein, 9 aa, Artificial Sequence
  Description of Artificial Sequence: Synthetic peptide
TFFNYDYFD

SEQ ID NO: 328 - protein, 7 aa, Artificial Sequence
  Description of Artificial Sequence: Synthetic peptide
SQDVGTD

SEQ ID NO: 329 - protein, 3 aa, Artificial Sequence
  Description of Artificial Sequence: Synthetic peptide
WAS

SEQ ID NO: 330 - protein, 6 aa, Artificial Sequence
  Description of Artificial Sequence: Synthetic peptide
YSRYPW

SEQ ID NO: 331 - protein, 7 aa, Artificial Sequence
  Description of Artificial Sequence: Synthetic peptide
GFSLTSY

SEQ ID NO: 332 - protein, 5 aa, Artificial Sequence
  Description of Artificial Sequence: Synthetic peptide
WAGGG

SEQ ID NO: 333 - protein, 10 aa, Artificial Sequence
  Description of Artificial Sequence: Synthetic peptide
GTFFNYDYFD

SEQ ID NO: 334 - protein, 7 aa, Artificial Sequence
  Description of Artificial Sequence: Synthetic peptide
SQDVGTD

SEQ ID NO: 335 - protein, 3 aa, Artificial Sequence
  Description of Artificial Sequence: Synthetic peptide
WAS

SEQ ID NO: 336 - protein, 6 aa, Artificial Sequence
  Description of Artificial Sequence: Synthetic peptide
YSRYPW

SEQ ID NO: 337 - protein, 6 aa, Artificial Sequence
  Description of Artificial Sequence: Synthetic peptide
TSYGVH

SEQ ID NO: 338 - protein, 12 aa, Artificial Sequence
  Description of Artificial Sequence: Synthetic peptide
WLGIIWAGGGTN

SEQ ID NO: 339 - protein, 12 aa, Artificial Sequence
  Description of Artificial Sequence: Synthetic peptide
ARGTFFNYDYFD

SEQ ID NO: 340 - protein, 7 aa, Artificial Sequence
  Description of Artificial Sequence: Synthetic peptide
GTDVAWY

SEQ ID NO: 341 - protein, 10 aa, Artificial Sequence
  Description of Artificial Sequence: Synthetic peptide
LMIYWASTRH

SEQ ID NO: 342 - protein, 8 aa, Artificial Sequence
  Description of Artificial Sequence: Synthetic peptide
QQYSRYPW

SEQ ID NO: 343 - protein, 10 aa, Artificial Sequence
  Description of Artificial Sequence: Synthetic peptide
GFSLTSYGVH

SEQ ID NO: 344 - protein, 9 aa, Artificial Sequence
  Description of Artificial Sequence: Synthetic peptide
IIWAGGGTN

SEQ ID NO: 345 - protein, 11 aa, Artificial Sequence
  Description of Artificial Sequence: Synthetic peptide
GTFFNYDYFDY

SEQ ID NO: 346 - protein, 11 aa, Artificial Sequence
  Description of Artificial Sequence: Synthetic peptide
KASQDVGTDVA

SEQ ID NO: 347 - protein, 7 aa, Artificial Sequence
  Description of Artificial Sequence: Synthetic peptide
WASTRHT

SEQ ID NO: 348 - protein, 9 aa, Artificial Sequence
  Description of Artificial Sequence: Synthetic peptide
QQYSRYPWT

SEQ ID NO: 349 - protein, 10 aa, Artificial Sequence
  Description of Artificial Sequence: Synthetic peptide
GFSLTSYGVH

SEQ ID NO: 350 - protein, 16 aa, Artificial Sequence
  Description of Artificial Sequence: Synthetic peptide
IIWAGGNTNSNSALMS

SEQ ID NO: 351 - protein, 11 aa, Artificial Sequence
  Description of Artificial Sequence: Synthetic peptide
GSFYSYLYFDY

SEQ ID NO: 352 - protein, 11 aa, Artificial Sequence
  Description of Artificial Sequence: Synthetic peptide
RASKSISKYLA

SEQ ID NO: 353 - protein, 7 aa, Artificial Sequence
  Description of Artificial Sequence: Synthetic peptide
SGSTLQS

SEQ ID NO: 354 - protein, 9 aa, Artificial Sequence
  Description of Artificial Sequence: Synthetic peptide
QQHNDYPLT

SEQ ID NO: 355 - protein, 8 aa, Artificial Sequence
  Description of Artificial Sequence: Synthetic peptide
GFSLTSYG

SEQ ID NO: 356 - protein, 7 aa, Artificial Sequence
  Description of Artificial Sequence: Synthetic peptide
IWAGGNT

SEQ ID NO: 357 - protein, 13 aa, Artificial Sequence
  Description of Artificial Sequence: Synthetic peptide
ARGSFYSYLYFDY

SEQ ID NO: 358 - protein, 6 aa, Artificial Sequence
  Description of Artificial Sequence: Synthetic peptide
KSISKY

SEQ ID NO: 359 - protein, 3 aa, Artificial Sequence
  Description of Artificial Sequence: Synthetic peptide
SGS

SEQ ID NO: 360 - protein, 9 aa, Artificial Sequence
  Description of Artificial Sequence: Synthetic peptide
QQHNDYPLT

SEQ ID NO: 361 - protein, 5 aa, Artificial Sequence
  Description of Artificial Sequence: Synthetic peptide
SYGVH

SEQ ID NO: 362 - protein, 16 aa, Artificial Sequence
  Description of Artificial Sequence: Synthetic peptide
IIWAGGNTNSNSALMS

SEQ ID NO: 363 - protein, 11 aa, Artificial Sequence
  Description of Artificial Sequence: Synthetic peptide
GSFYSYLYFDY

SEQ ID NO: 364 - protein, 11 aa, Artificial Sequence
  Description of Artificial Sequence: Synthetic peptide
RASKSISKYLA

SEQ ID NO: 365 - protein, 7 aa, Artificial Sequence
  Description of Artificial Sequence: Synthetic peptide
SGSTLQS

SEQ ID NO: 366 - protein, 9 aa, Artificial Sequence
  Description of Artificial Sequence: Synthetic peptide
QQHNDYPLT

SEQ ID NO: 367 - protein, 7 aa, Artificial Sequence
  Description of Artificial Sequence: Synthetic peptide
GFSLTSY

SEQ ID NO: 368 - protein, 3 aa, Artificial Sequence
  Description of Artificial Sequence: Synthetic peptide
AGG

SEQ ID NO: 369 - protein, 9 aa, Artificial Sequence
  Description of Artificial Sequence: Synthetic peptide
SFYSYLYFD

SEQ ID NO: 370 - protein, 7 aa, Artificial Sequence
  Description of Artificial Sequence: Synthetic peptide
SKSISKY

SEQ ID NO: 371 - protein, 3 aa, Artificial Sequence
  Description of Artificial Sequence: Synthetic peptide
SGS

SEQ ID NO: 372 - protein, 6 aa, Artificial Sequence
  Description of Artificial Sequence: Synthetic peptide
HNDYPL

SEQ ID NO: 373 - protein, 7 aa, Artificial Sequence
  Description of Artificial Sequence: Synthetic peptide
GFSLTSY

SEQ ID NO: 374 - protein, 5 aa, Artificial Sequence
  Description of Artificial Sequence: Synthetic peptide
WAGGN

SEQ ID NO: 375 - protein, 10 aa, Artificial Sequence
  Description of Artificial Sequence: Synthetic peptide
GSFYSYLYFD

SEQ ID NO: 376 - protein, 7 aa, Artificial Sequence
  Description of Artificial Sequence: Synthetic peptide
SKSISKY

SEQ ID NO: 377 - protein, 3 aa, Artificial Sequence
  Description of Artificial Sequence: Synthetic peptide
SGS

SEQ ID NO: 378 - protein, 6 aa, Artificial Sequence
  Description of Artificial Sequence: Synthetic peptide
HNDYPL

SEQ ID NO: 379 - protein, 6 aa, Artificial Sequence
  Description of Artificial Sequence: Synthetic peptide
TSYGVH

SEQ ID NO: 380 - protein, 12 aa, Artificial Sequence
  Description of Artificial Sequence: Synthetic peptide
WLGIIWAGGNTN

SEQ ID NO: 381 - protein, 12 aa, Artificial Sequence
  Description of Artificial Sequence: Synthetic peptide
ARGSFYSYLYFD

SEQ ID NO: 382 - protein, 7 aa, Artificial Sequence
  Description of Artificial Sequence: Synthetic peptide
SKYLAWY

SEQ ID NO: 383 - protein, 10 aa, Artificial Sequence
  Description of Artificial Sequence: Synthetic peptide
LLIYSGSTLQ

SEQ ID NO: 384 - protein, 8 aa, Artificial Sequence
  Description of Artificial Sequence: Synthetic peptide
QQHNDYPL

SEQ ID NO: 385 - protein, 10 aa, Artificial Sequence
  Description of Artificial Sequence: Synthetic peptide
GFSLTSYGVH

SEQ ID NO: 386 - protein, 9 aa, Artificial Sequence
  Description of Artificial Sequence: Synthetic peptide
IIWAGGNTN

SEQ ID NO: 387 - protein, 11 aa, Artificial Sequence
  Description of Artificial Sequence: Synthetic peptide
GSFYSYLYFDY

SEQ ID NO: 388 - protein, 11 aa, Artificial Sequence
  Description of Artificial Sequence: Synthetic peptide
RASKSISKYLA

SEQ ID NO: 389 - protein, 7 aa, Artificial Sequence
  Description of Artificial Sequence: Synthetic peptide
SGSTLQS

SEQ ID NO: 390 - protein, 9 aa, Artificial Sequence
  Description of Artificial Sequence: Synthetic peptide
QQHNDYPLT

SEQ ID NO: 391 - protein, 10 aa, Artificial Sequence
  Description of Artificial Sequence: Synthetic peptide
GFSLSSYAIS

SEQ ID NO: 392 - protein, 16 aa, Artificial Sequence
  Description of Artificial Sequence: Synthetic peptide
VIWAGGGTNYNSALKS

SEQ ID NO: 393 - protein, 12 aa, Artificial Sequence
  Description of Artificial Sequence: Synthetic peptide
NFFYDYDDGMDY

SEQ ID NO: 394 - protein, 16 aa, Artificial Sequence
  Description of Artificial Sequence: Synthetic peptide
RSSQSLVHSNGNTYLH

SEQ ID NO: 395 - protein, 7 aa, Artificial Sequence
  Description of Artificial Sequence: Synthetic peptide
KVSNRFS

SEQ ID NO: 396 - protein, 9 aa, Artificial Sequence
  Description of Artificial Sequence: Synthetic peptide
SQSTHVPLT

SEQ ID NO: 397 - protein, 8 aa, Artificial Sequence
  Description of Artificial Sequence: Synthetic peptide
GFSLSSYA

SEQ ID NO: 398 - protein, 7 aa, Artificial Sequence
  Description of Artificial Sequence: Synthetic peptide
IWAGGGT

SEQ ID NO: 399 - protein, 14 aa, Artificial Sequence
  Description of Artificial Sequence: Synthetic peptide
ARNFFYDYDDGMDY

SEQ ID NO: 400 - protein, 11 aa, Artificial Sequence
  Description of Artificial Sequence: Synthetic peptide
QSLVHSNGNTY

SEQ ID NO: 401 - protein, 3 aa, Artificial Sequence
  Description of Artificial Sequence: Synthetic peptide
KVS

SEQ ID NO: 402 - protein, 9 aa, Artificial Sequence
  Description of Artificial Sequence: Synthetic peptide
SQSTHVPLT

SEQ ID NO: 403 - protein, 5 aa, Artificial Sequence
  Description of Artificial Sequence: Synthetic peptide
SYAIS

SEQ ID NO: 404 - protein, 16 aa, Artificial Sequence
  Description of Artificial Sequence: Synthetic peptide
VIWAGGGTNYNSALKS

SEQ ID NO: 405 - protein, 12 aa, Artificial Sequence
  Description of Artificial Sequence: Synthetic peptide
NFFYDYDDGMDY

SEQ ID NO: 406 - protein, 16 aa, Artificial Sequence
  Description of Artificial Sequence: Synthetic peptide
RSSQSLVHSNGNTYLH

SEQ ID NO: 407 - protein, 7 aa, Artificial Sequence
  Description of Artificial Sequence: Synthetic peptide
KVSNRFS

SEQ ID NO: 408 - protein, 9 aa, Artificial Sequence
  Description of Artificial Sequence: Synthetic peptide
SQSTHVPLT

SEQ ID NO: 409 - protein, 7 aa, Artificial Sequence
  Description of Artificial Sequence: Synthetic peptide
GFSLSSY

SEQ ID NO: 410 - protein, 3 aa, Artificial Sequence
  Description of Artificial Sequence: Synthetic peptide
AGG

SEQ ID NO: 411 - protein, 10 aa, Artificial Sequence
  Description of Artificial Sequence: Synthetic peptide
FFYDYDDGMD

SEQ ID NO: 412 - protein, 12 aa, Artificial Sequence
  Description of Artificial Sequence: Synthetic peptide
SQSLVHSNGNTY

SEQ ID NO: 413 - protein, 3 aa, Artificial Sequence
  Description of Artificial Sequence: Synthetic peptide
KVS

SEQ ID NO: 414 - protein, 6 aa, Artificial Sequence
  Description of Artificial Sequence: Synthetic peptide
STHVPL

SEQ ID NO: 415 - protein, 7 aa, Artificial Sequence
  Description of Artificial Sequence: Synthetic peptide
GFSLSSY

SEQ ID NO: 416 - protein, 5 aa, Artificial Sequence
  Description of Artificial Sequence: Synthetic peptide
WAGGG

SEQ ID NO: 417 - protein, 11 aa, Artificial Sequence
  Description of Artificial Sequence: Synthetic peptide
NFFYDYDDGMD

SEQ ID NO: 418 - protein, 12 aa, Artificial Sequence
  Description of Artificial Sequence: Synthetic peptide
SQSLVHSNGNTY

SEQ ID NO: 419 - protein, 3 aa, Artificial Sequence
  Description of Artificial Sequence: Synthetic peptide
KVS

SEQ ID NO: 420 - protein, 6 aa, Artificial Sequence
  Description of Artificial Sequence: Synthetic peptide
STHVPL

SEQ ID NO: 421 - protein, 6 aa, Artificial Sequence
  Description of Artificial Sequence: Synthetic peptide
SSYAIS

SEQ ID NO: 422 - protein, 12 aa, Artificial Sequence
  Description of Artificial Sequence: Synthetic peptide
WLGVIWAGGGTN

SEQ ID NO: 423 - protein, 13 aa, Artificial Sequence
  Description of Artificial Sequence: Synthetic peptide
ARNFFYDYDDGMD

SEQ ID NO: 424 - protein, 12 aa, Artificial Sequence
  Description of Artificial Sequence: Synthetic peptide
VHSNGNTYLHWY

SEQ ID NO: 425 - protein, 10 aa, Artificial Sequence
  Description of Artificial Sequence: Synthetic peptide
LLIYKVSNRF

SEQ ID NO: 426 - protein, 8 aa, Artificial Sequence
  Description of Artificial Sequence: Synthetic peptide
SQSTHVPL

SEQ ID NO: 427 - protein, 10 aa, Artificial Sequence
  Description of Artificial Sequence: Synthetic peptide
GFSLSSYAIS

SEQ ID NO: 428 - protein, 9 aa, Artificial Sequence
  Description of Artificial Sequence: Synthetic peptide
VIWAGGGTN

SEQ ID NO: 429 - protein, 12 aa, Artificial Sequence
  Description of Artificial Sequence: Synthetic peptide
NFFYDYDDGMDY

SEQ ID NO: 430 - protein, 16 aa, Artificial Sequence
  Description of Artificial Sequence: Synthetic peptide
RSSQSLVHSNGNTYLH

SEQ ID NO: 431 - protein, 7 aa, Artificial Sequence
  Description of Artificial Sequence: Synthetic peptide
KVSNRFS

SEQ ID NO: 432 - protein, 9 aa, Artificial Sequence
  Description of Artificial Sequence: Synthetic peptide
SQSTHVPLT

SEQ ID NO: 433 - protein, 10 aa, Artificial Sequence
  Description of Artificial Sequence: Synthetic peptide
GYTFTNYGMN

SEQ ID NO: 434 - protein, 17 aa, Artificial Sequence
  Description of Artificial Sequence: Synthetic peptide
WINTYTGEPTYADDFKG

SEQ ID NO: 435 - protein, 10 aa, Artificial Sequence
  Description of Artificial Sequence: Synthetic peptide
PYFGDYAMDY

SEQ ID NO: 436 - protein, 11 aa, Artificial Sequence
  Description of Artificial Sequence: Synthetic peptide
RASENIYSNLA

SEQ ID NO: 437 - protein, 7 aa, Artificial Sequence
  Description of Artificial Sequence: Synthetic peptide
TATNLAD

SEQ ID NO: 438 - protein, 9 aa, Artificial Sequence
  Description of Artificial Sequence: Synthetic peptide
QHFWGNPWT

SEQ ID NO: 439 - protein, 8 aa, Artificial Sequence
  Description of Artificial Sequence: Synthetic peptide
GYTFTNYG

SEQ ID NO: 440 - protein, 8 aa, Artificial Sequence
  Description of Artificial Sequence: Synthetic peptide
INTYTGEP

SEQ ID NO: 441 - protein, 12 aa, Artificial Sequence
  Description of Artificial Sequence: Synthetic peptide
ARPYFGDYAMDY

SEQ ID NO: 442 - protein, 6 aa, Artificial Sequence
  Description of Artificial Sequence: Synthetic peptide
ENIYSN

SEQ ID NO: 443 - protein, 3 aa, Artificial Sequence
  Description of Artificial Sequence: Synthetic peptide
TAT

SEQ ID NO: 444 - protein, 9 aa, Artificial Sequence
  Description of Artificial Sequence: Synthetic peptide
QHFWGNPWT

SEQ ID NO: 445 - protein, 5 aa, Artificial Sequence
  Description of Artificial Sequence: Synthetic peptide
NYGMN

SEQ ID NO: 446 - protein, 17 aa, Artificial Sequence
  Description of Artificial Sequence: Synthetic peptide
WINTYTGEPTYADDFKG

SEQ ID NO: 447 - protein, 10 aa, Artificial Sequence
  Description of Artificial Sequence: Synthetic peptide
PYFGDYAMDY

SEQ ID NO: 448 - protein, 11 aa, Artificial Sequence
  Description of Artificial Sequence: Synthetic peptide
RASENIYSNLA

SEQ ID NO: 449 - protein, 7 aa, Artificial Sequence
  Description of Artificial Sequence: Synthetic peptide
TATNLAD

SEQ ID NO: 450 - protein, 9 aa, Artificial Sequence
  Description of Artificial Sequence: Synthetic peptide
QHFWGNPWT

SEQ ID NO: 451 - protein, 7 aa, Artificial Sequence
  Description of Artificial Sequence: Synthetic peptide
GYTFTNY

SEQ ID NO: 452 - protein, 4 aa, Artificial Sequence
  Description of Artificial Sequence: Synthetic peptide
TYTG

SEQ ID NO: 453 - protein, 8 aa, Artificial Sequence
  Description of Artificial Sequence: Synthetic peptide
YFGDYAMD

SEQ ID NO: 454 - protein, 7 aa, Artificial Sequence
  Description of Artificial Sequence: Synthetic peptide
SENIYSN

SEQ ID NO: 455 - protein, 3 aa, Artificial Sequence
  Description of Artificial Sequence: Synthetic peptide
TAT

SEQ ID NO: 456 - protein, 6 aa, Artificial Sequence
  Description of Artificial Sequence: Synthetic peptide
FWGNPW

SEQ ID NO: 457 - protein, 7 aa, Artificial Sequence
  Description of Artificial Sequence: Synthetic peptide
GYTFTNY

SEQ ID NO: 458 - protein, 6 aa, Artificial Sequence
  Description of Artificial Sequence: Synthetic peptide
NTYTGE

SEQ ID NO: 459 - protein, 9 aa, Artificial Sequence
  Description of Artificial Sequence: Synthetic peptide
PYFGDYAMD

SEQ ID NO: 460 - protein, 7 aa, Artificial Sequence
  Description of Artificial Sequence: Synthetic peptide
SENIYSN

SEQ ID NO: 461 - protein, 3 aa, Artificial Sequence
  Description of Artificial Sequence: Synthetic peptide
TAT

SEQ ID NO: 462 - protein, 6 aa, Artificial Sequence
  Description of Artificial Sequence: Synthetic peptide
FWGNPW

SEQ ID NO: 463 - protein, 6 aa, Artificial Sequence
  Description of Artificial Sequence: Synthetic peptide
TNYGMN

SEQ ID NO: 464 - protein, 13 aa, Artificial Sequence
  Description of Artificial Sequence: Synthetic peptide
WMGWINTYTGEPT

SEQ ID NO: 465 - protein, 11 aa, Artificial Sequence
  Description of Artificial Sequence: Synthetic peptide
ARPYFGDYAMD

SEQ ID NO: 466 - protein, 7 aa, Artificial Sequence
  Description of Artificial Sequence: Synthetic peptide
YSNLAWY

SEQ ID NO: 467 - protein, 10 aa, Artificial Sequence
  Description of Artificial Sequence: Synthetic peptide
VLVYTATNLA

SEQ ID NO: 468 - protein, 8 aa, Artificial Sequence
  Description of Artificial Sequence: Synthetic peptide
QHFWGNPW

SEQ ID NO: 469 - protein, 10 aa, Artificial Sequence
  Description of Artificial Sequence: Synthetic peptide
GYTFTNYGMN

SEQ ID NO: 470 - protein, 10 aa, Artificial Sequence
  Description of Artificial Sequence: Synthetic peptide
WINTYTGEPT

SEQ ID NO: 471 - protein, 10 aa, Artificial Sequence
  Description of Artificial Sequence: Synthetic peptide
PYFGDYAMDY

SEQ ID NO: 472 - protein, 11 aa, Artificial Sequence
  Description of Artificial Sequence: Synthetic peptide
RASENIYSNLA

SEQ ID NO: 473 - protein, 7 aa, Artificial Sequence
  Description of Artificial Sequence: Synthetic peptide
TATNLAD

SEQ ID NO: 474 - protein, 9 aa, Artificial Sequence
  Description of Artificial Sequence: Synthetic peptide
QHFWGNPWT

SEQ ID NO: 475 - protein, 10 aa, Artificial Sequence
  Description of Artificial Sequence: Synthetic peptide
GFSLTSYAIS

SEQ ID NO: 476 - protein, 16 aa, Artificial Sequence
  Description of Artificial Sequence: Synthetic peptide
IIWAGGGTNYNSALKS

SEQ ID NO: 477 - protein, 12 aa, Artificial Sequence
  Description of Artificial Sequence: Synthetic peptide
NPFYDYDEGLDY

SEQ ID NO: 478 - protein, 16 aa, Artificial Sequence
  Description of Artificial Sequence: Synthetic peptide
RSSQSLVHSNGNTYLH

SEQ ID NO: 479 - protein, 7 aa, Artificial Sequence
  Description of Artificial Sequence: Synthetic peptide
KVSNRFS

SEQ ID NO: 480 - protein, 9 aa, Artificial Sequence
  Description of Artificial Sequence: Synthetic peptide
SQSTHVPWT

SEQ ID NO: 481 - protein, 8 aa, Artificial Sequence
  Description of Artificial Sequence: Synthetic peptide
GFSLTSYA

SEQ ID NO: 482 - protein, 7 aa, Artificial Sequence
  Description of Artificial Sequence: Synthetic peptide
IWAGGGT

SEQ ID NO: 483 - protein, 14 aa, Artificial Sequence
  Description of Artificial Sequence: Synthetic peptide
ARNPFYDYDEGLDY

SEQ ID NO: 484 - protein, 11 aa, Artificial Sequence
  Description of Artificial Sequence: Synthetic peptide
QSLVHSNGNTY

SEQ ID NO: 485 - protein, 3 aa, Artificial Sequence
  Description of Artificial Sequence: Synthetic peptide
KVS

SEQ ID NO: 486 - protein, 9 aa, Artificial Sequence
  Description of Artificial Sequence: Synthetic peptide
SQSTHVPWT

SEQ ID NO: 487 - protein, 5 aa, Artificial Sequence
  Description of Artificial Sequence: Synthetic peptide
SYAIS

SEQ ID NO: 488 - protein, 16 aa, Artificial Sequence
  Description of Artificial Sequence: Synthetic peptide
IIWAGGGTNYNSALKS

SEQ ID NO: 489 - protein, 12 aa, Artificial Sequence
  Description of Artificial Sequence: Synthetic peptide
NPFYDYDEGLDY

SEQ ID NO: 490 - protein, 16 aa, Artificial Sequence
  Description of Artificial Sequence: Synthetic peptide
RSSQSLVHSNGNTYLH

SEQ ID NO: 491 - protein, 7 aa, Artificial Sequence
  Description of Artificial Sequence: Synthetic peptide
KVSNRFS

SEQ ID NO: 492 - protein, 9 aa, Artificial Sequence
  Description of Artificial Sequence: Synthetic peptide
SQSTHVPWT

SEQ ID NO: 493 - protein, 7 aa, Artificial Sequence
  Description of Artificial Sequence: Synthetic peptide
GFSLTSY

SEQ ID NO: 494 - protein, 3 aa, Artificial Sequence
  Description of Artificial Sequence: Synthetic peptide
AGG

SEQ ID NO: 495 - protein, 10 aa, Artificial Sequence
  Description of Artificial Sequence: Synthetic peptide
PFYDYDEGLD

SEQ ID NO: 496 - protein, 12 aa, Artificial Sequence
  Description of Artificial Sequence: Synthetic peptide
SQSLVHSNGNTY

SEQ ID NO: 497 - protein, 3 aa, Artificial Sequence
  Description of Artificial Sequence: Synthetic peptide
KVS

SEQ ID NO: 498 - protein, 6 aa, Artificial Sequence
  Description of Artificial Sequence: Synthetic peptide
STHVPW

SEQ ID NO: 499 - protein, 7 aa, Artificial Sequence
  Description of Artificial Sequence: Synthetic peptide
GFSLTSY

SEQ ID NO: 500 - protein, 5 aa, Artificial Sequence
  Description of Artificial Sequence: Synthetic peptide
WAGGG

SEQ ID NO: 501 - protein, 11 aa, Artificial Sequence
  Description of Artificial Sequence: Synthetic peptide
NPFYDYDEGLD

SEQ ID NO: 502 - protein, 12 aa, Artificial Sequence
  Description of Artificial Sequence: Synthetic peptide
SQSLVHSNGNTY

SEQ ID NO: 503 - protein, 3 aa, Artificial Sequence
  Description of Artificial Sequence: Synthetic peptide
KVS

SEQ ID NO: 504 - protein, 6 aa, Artificial Sequence
  Description of Artificial Sequence: Synthetic peptide
STHVPW

SEQ ID NO: 505 - protein, 6 aa, Artificial Sequence
  Description of Artificial Sequence: Synthetic peptide
TSYAIS

SEQ ID NO: 506 - protein, 12 aa, Artificial Sequence
  Description of Artificial Sequence: Synthetic peptide
WLGIIWAGGGTN

SEQ ID NO: 507 - protein, 13 aa, Artificial Sequence
  Description of Artificial Sequence: Synthetic peptide
ARNPFYDYDEGLD

SEQ ID NO: 508 - protein, 12 aa, Artificial Sequence
  Description of Artificial Sequence: Synthetic peptide
VHSNGNTYLHWY

SEQ ID NO: 509 - protein, 10 aa, Artificial Sequence
  Description of Artificial Sequence: Synthetic peptide
LLIYKVSNRF

SEQ ID NO: 510 - protein, 8 aa, Artificial Sequence
  Description of Artificial Sequence: Synthetic peptide
SQSTHVPW

SEQ ID NO: 511 - protein, 10 aa, Artificial Sequence
  Description of Artificial Sequence: Synthetic peptide
GFSLTSYAIS

SEQ ID NO: 512 - protein, 9 aa, Artificial Sequence
  Description of Artificial Sequence: Synthetic peptide
IIWAGGGTN

SEQ ID NO: 513 - protein, 12 aa, Artificial Sequence
  Description of Artificial Sequence: Synthetic peptide
NPFYDYDEGLDY

SEQ ID NO: 514 - protein, 16 aa, Artificial Sequence
  Description of Artificial Sequence: Synthetic peptide
RSSQSLVHSNGNTYLH

SEQ ID NO: 515 - protein, 7 aa, Artificial Sequence
  Description of Artificial Sequence: Synthetic peptide
KVSNRFS

SEQ ID NO: 516 - protein, 9 aa, Artificial Sequence
  Description of Artificial Sequence: Synthetic peptide
SQSTHVPWT

SEQ ID NO: 517 - protein, 10 aa, Artificial Sequence
  Description of Artificial Sequence: Synthetic peptide
GFSLTSYGVH

SEQ ID NO: 518 - protein, 16 aa, Artificial Sequence
  Description of Artificial Sequence: Synthetic peptide
VIWAGGNTNYNSTLMS

SEQ ID NO: 519 - protein, 11 aa, Artificial Sequence
  Description of Artificial Sequence: Synthetic peptide
GSFYDYLYFDY

SEQ ID NO: 520 - protein, 11 aa, Artificial Sequence
  Description of Artificial Sequence: Synthetic peptide
RASKSISKYLA

SEQ ID NO: 521 - protein, 7 aa, Artificial Sequence
  Description of Artificial Sequence: Synthetic peptide
SGSTLQS

SEQ ID NO: 522 - protein, 9 aa, Artificial Sequence
  Description of Artificial Sequence: Synthetic peptide
QQHNEYPLT

SEQ ID NO: 523 - protein, 8 aa, Artificial Sequence
  Description of Artificial Sequence: Synthetic peptide
GFSLTSYG

SEQ ID NO: 524 - protein, 7 aa, Artificial Sequence
  Description of Artificial Sequence: Synthetic peptide
IWAGGNT

SEQ ID NO: 525 - protein, 13 aa, Artificial Sequence
  Description of Artificial Sequence: Synthetic peptide
ARGSFYDYLYFDY

SEQ ID NO: 526 - protein, 6 aa, Artificial Sequence
  Description of Artificial Sequence: Synthetic peptide
KSISKY

SEQ ID NO: 527 - protein, 3 aa, Artificial Sequence
  Description of Artificial Sequence: Synthetic peptide
SGS

SEQ ID NO: 528 - protein, 9 aa, Artificial Sequence
  Description of Artificial Sequence: Synthetic peptide
QQHNEYPLT

SEQ ID NO: 529 - protein, 5 aa, Artificial Sequence
  Description of Artificial Sequence: Synthetic peptide
SYGVH

SEQ ID NO: 530 - protein, 16 aa, Artificial Sequence
  Description of Artificial Sequence: Synthetic peptide
VIWAGGNTNYNSTLMS

SEQ ID NO: 531 - protein, 11 aa, Artificial Sequence
  Description of Artificial Sequence: Synthetic peptide
GSFYDYLYFDY

SEQ ID NO: 532 - protein, 11 aa, Artificial Sequence
  Description of Artificial Sequence: Synthetic peptide
RASKSISKYLA

SEQ ID NO: 533 - protein, 7 aa, Artificial Sequence
  Description of Artificial Sequence: Synthetic peptide
SGSTLQS

SEQ ID NO: 534 - protein, 9 aa, Artificial Sequence
  Description of Artificial Sequence: Synthetic peptide
QQHNEYPLT

SEQ ID NO: 535 - protein, 7 aa, Artificial Sequence
  Description of Artificial Sequence: Synthetic peptide
GFSLTSY

SEQ ID NO: 536 - protein, 3 aa, Artificial Sequence
  Description of Artificial Sequence: Synthetic peptide
AGG

SEQ ID NO: 537 - protein, 9 aa, Artificial Sequence
  Description of Artificial Sequence: Synthetic peptide
SFYDYLYFD

SEQ ID NO: 538 - protein, 7 aa, Artificial Sequence
  Description of Artificial Sequence: Synthetic peptide
SKSISKY

SEQ ID NO: 539 - protein, 3 aa, Artificial Sequence
  Description of Artificial Sequence: Synthetic peptide
SGS

SEQ ID NO: 540 - protein, 6 aa, Artificial Sequence
  Description of Artificial Sequence: Synthetic peptide
HNEYPL

SEQ ID NO: 541 - protein, 7 aa, Artificial Sequence
  Description of Artificial Sequence: Synthetic peptide
GFSLTSY

SEQ ID NO: 542 - protein, 5 aa, Artificial Sequence
  Description of Artificial Sequence: Synthetic peptide
WAGGN

SEQ ID NO: 543 - protein, 10 aa, Artificial Sequence
  Description of Artificial Sequence: Synthetic peptide
GSFYDYLYFD

SEQ ID NO: 544 - protein, 7 aa, Artificial Sequence
  Description of Artificial Sequence: Synthetic peptide
SKSISKY

SEQ ID NO: 545 - protein, 3 aa, Artificial Sequence
  Description of Artificial Sequence: Synthetic peptide
SGS

SEQ ID NO: 546 - protein, 6 aa, Artificial Sequence
  Description of Artificial Sequence: Synthetic peptide
HNEYPL

SEQ ID NO: 547 - protein, 6 aa, Artificial Sequence
  Description of Artificial Sequence: Synthetic peptide
TSYGVH

SEQ ID NO: 548 - protein, 12 aa, Artificial Sequence
  Description of Artificial Sequence: Synthetic peptide
WLGVIWAGGNTN

SEQ ID NO: 549 - protein, 12 aa, Artificial Sequence
  Description of Artificial Sequence: Synthetic peptide
ARGSFYDYLYFD

SEQ ID NO: 550 - protein, 7 aa, Artificial Sequence
  Description of Artificial Sequence: Synthetic peptide
SKYLAWY

SEQ ID NO: 551 - protein, 10 aa, Artificial Sequence
  Description of Artificial Sequence: Synthetic peptide
LLIYSGSTLQ

SEQ ID NO: 552 - protein, 8 aa, Artificial Sequence
  Description of Artificial Sequence: Synthetic peptide
QQHNEYPL

SEQ ID NO: 553 - protein, 10 aa, Artificial Sequence
  Description of Artificial Sequence: Synthetic peptide
GFSLTSYGVH

SEQ ID NO: 554 - protein, 9 aa, Artificial Sequence
  Description of Artificial Sequence: Synthetic peptide
VIWAGGNTN

SEQ ID NO: 555 - protein, 11 aa, Artificial Sequence
  Description of Artificial Sequence: Synthetic peptide
GSFYDYLYFDY

SEQ ID NO: 556 - protein, 11 aa, Artificial Sequence
  Description of Artificial Sequence: Synthetic peptide
RASKSISKYLA

SEQ ID NO: 557 - protein, 7 aa, Artificial Sequence
  Description of Artificial Sequence: Synthetic peptide
SGSTLQS

SEQ ID NO: 558 - protein, 9 aa, Artificial Sequence
  Description of Artificial Sequence: Synthetic peptide
QQHNEYPLT

SEQ ID NO: 559 - protein, 502 aa, Artificial Sequence
  Description of Artificial Sequence: Synthetic polypeptide
MAWVWTLLFLMAAAQSIQAEIVLTQSPGTLSLSPGERATLSCRASQSISSSFLTWYQQKPGQAPRLLIYGASSRATGIPDRFSGGGSGTDFTLTISRLEPEDFAVYYCQHYGSSPMYTFGQGTKLEIKGGSEGKSSGSGSESKSTGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDEGYSSGHYYGMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 560 - protein, 475 aa, Artificial Sequence
  Description of Artificial Sequence: Synthetic polypeptide
VDGGITQSPKYLFRKEGQNVTLSCEQNLNHDAMYWYRQDPGQGLRLIYYSQIVNDFQKGDIAEGYSVSREKKESFPLTVTSAQKNPTAFYLCASSSRSSYEQYFGPGTRLTVTEDLKNVFPPEVAVFEPSEAEISHTQKATLVCLATGFYPDHVELSWWVNGKEVHSGVSTDPQPLKEQPALNDSRYSLSSRLRVSATFWQNPRNHFRCQVQFYGLSENDEWTQDRAKPVTQIVSAEAWGRADEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 561 - protein, 431 aa, Artificial Sequence
  Description of Artificial Sequence: Synthetic polypeptide
QLLEQSPQFLSIQEGENLTVYCNSSSVFSSLQWYRQEPGEGPVLLVTVVTGGEVKKLKRLTFQFGDARKDSSLHITAAQPGDTGLYLCAGAGSQGNLIFGKGTKLSVKPNIQNPDPAVYQLRDSKSSDKSVCLFTDFDSQTNVSQSKDSDVYITDKTVLDMRSMDFKSNSAVAWSNKSDFACANAFNNSIIPEDTFFPSEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 562 - protein, 467 aa, Artificial Sequence
  Description of Artificial Sequence: Synthetic polypeptide
MAWVWTLLFLMAAAQSIQAQVQLKESGPGLVAPSQSLSITCTVSGFSLTSYGVHWVRQPPGKGLEWLGIIWAGGGTNYNSALMSRLSITKDNSKSQVSLKMNSLQTDDTAMYYCARGTFFNYDYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPG

SEQ ID NO: 563 - protein, 233 aa, Artificial Sequence
  Description of Artificial Sequence: Synthetic polypeptide
MAWVWTLLFLMAAAQSIQADIVMTQSQKFMSTSVGDRVSITCKASQDVGTDVAWYQQKPGQSPKLMIYWASTRHTGVPDRFTGSGSGTDFTLTISNVQSEDLADYFCQQYSRYPWTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 564 - protein, 467 aa, Artificial Sequence
  Description of Artificial Sequence: Synthetic polypeptide
MAWVWTLLFLMAAAQSIQAQVQLKESGPVLVAPSQSLSITCTVSGFSLTSYGVHWVRQPPGKGLEWLGIIWAGGNTNSNSALMSRLSISKDNSKSQVFLKMNSLQTDDTAMYYCARGSFYSYLYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPG

SEQ ID NO: 565 - protein, 233 aa, Artificial Sequence
  Description of Artificial Sequence: Synthetic polypeptide
MAWVWTLLFLMAAAQSIQADIVMTQSPSYLAASPGETITINCRASKSISKYLAWYQEKPGKTNKLLIYSGSTLQSGIPSRFSGSGSGTDFTLTISSLEPEDFAMYYCQQHNDYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 566 - protein, 468 aa, Artificial Sequence
  Description of Artificial Sequence: Synthetic polypeptide
MAWVWTLLFLMAAAQSIQAQITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPG

SEQ ID NO: 567 - protein, 238 aa, Artificial Sequence
  Description of Artificial Sequence: Synthetic polypeptide
METHSQVFVYMLLWLSGVEGDIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 568 - protein, 466 aa, Artificial Sequence
  Description of Artificial Sequence: Synthetic polypeptide
MAWVWTLLFLMAAAQSIQAQVQLQQSGPELVKPGASVKMSCKASGNTIPTYVMHWVKLKPGQGLEWIGYINPYNDGTKYNEKFKGKATLTSDKSSSTAYMELSSLTSEDSAVYYCAKDGTYVEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPG

SEQ ID NO: 569 - protein, 233 aa, Artificial Sequence
  Description of Artificial Sequence: Synthetic polypeptide
MAWVWTLLFLMAAAQSIQADIVMTQSRKFMSTSVGDRVNITCKASQNIRTAVAWFQQRPGQSPKLLFYLASNRHTGVPDRFTGSGSGTDFTLTINDVQSEDLADYFCLQHWNYPYTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 570 - protein, 468 aa, Artificial Sequence
  Description of Artificial Sequence: Synthetic polypeptide
MAWVWTLLFLMAAAQSIQAEVQLQQSGPELVKPGASVKMSCKASGYTFTRYVIHWMKQKPGQGLEWIGYVNPYNNGTKYTEKFKGKATLTSDKSSSTAYMELNSLTSEDSAVYYCARPRLSGEDAMEYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPG

SEQ ID NO: 571 - protein, 233 aa, Artificial Sequence
  Description of Artificial Sequence: Synthetic polypeptide
MAWVWTLLFLMAAAQSIQADIQMTQSPKSMSMSVGERVTLTCKASENVVTYVSWYQQKPEQSPKLLIYGASNRYTGVPDRFTGSGSATDFTLTISSVQAEDLAEYHCGQSHSFPYTFGSGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 572 - protein, 469 aa, Artificial Sequence
  Description of Artificial Sequence: Synthetic polypeptide
MAWVWTLLFLMAAAQSIQADVQLQESGPGLVAPSQSLSITCTVSGFSLSSYAISWVRQPPGKGLEWLGVIWAGGGTNYNSALKSRLSISKDNSKSQVFLKMKSLQTDDTARYYCARNFFYDYDDGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 573 - protein, 242 aa, Artificial Sequence
  Description of Artificial Sequence: Synthetic polypeptide
MARSALLILALLLLGLFSPGAWGNTQMNQTPLSLPVSLGDQASISCRSSQSLVHSNGNTYLHWYLQKPGQSPKLLIYKVSNRFSGVPDRFSGSGSGTDFTLKINRVEAEDLGVYFCSQSTHVPLTFGAGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 574 - protein, 468 aa, Artificial Sequence
  Description of Artificial Sequence: Synthetic polypeptide
MAWVWTLLFLMAAAQSIQAQIQLVQSGPELKKPGETVKISCKASGYTFTNYGMNWVKQAPGKGLKWMGWINTYTGEPTYADDFKGRFAFSLETSASTAYLQINNLKNEDMATYFCARPYFGDYAMDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 575 - protein, 237 aa, Artificial Sequence
  Description of Artificial Sequence: Synthetic polypeptide
MARSALLILALLLLGLFSPGAWGDVQMIQSPASLSVSVGETVTITCRASENIYSNLAWYQQKQGKSPQVLVYTATNLADGVPSRFSGSGSGTQYSLKINSLQSEDFGSYYCQHFWGNPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 576 - protein, 469 aa, Artificial Sequence
  Description of Artificial Sequence: Synthetic polypeptide
MAWVWTLLFLMAAAQSIQAQVQLQQSGPGLVAPSQSLSITCTVSGFSLTSYAISWIRQPPGKGLEWLGIIWAGGGTNYNSALKSRLSISKDNSKSQVFLKMNSLQIDDTARYYCARNPFYDYDEGLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 577 - protein, 242 aa, Artificial Sequence
  Description of Artificial Sequence: Synthetic polypeptide
MARSALLILALLLLGLFSPGAWGDIVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 578 - protein, 468 aa, Artificial Sequence
  Description of Artificial Sequence: Synthetic polypeptide
MAWVWTLLFLMAAAQSIQAQVQLKESGPVLVAPSQSLSITCTVSGFSLTSYGVHWIRQPPGKGLEWLGVIWAGGNTNYNSTLMSRLSISKDNSKSQVFLKMNSLQTDDTAMYYCARGSFYDYLYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 579 - protein, 237 aa, Artificial Sequence
  Description of Artificial Sequence: Synthetic polypeptide
MARSALLILALLLLGLFSPGAWGDIQMTQSPSYLAASPGETITINCRASKSISKYLAWYQEKPGKTNELLIYSGSTLQSGIPSRFSGSGSGTDFTLTISSLEPEDFAMYYCQQHNEYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 580 - protein, 10 aa, Artificial Sequence
  I3RB217 VH CDR1 (Exemplary)
GYSFTSYWIS

SEQ ID NO: 581 - protein, 17 aa, Artificial Sequence
  I3RB217 VH CDR2 (Exemplary)
IIDPSDSDTRYSPSFQG

SEQ ID NO: 582 - protein, 9 aa, Artificial Sequence
  I3RB217 VH CDR3 (Exemplary)
GDGSTDLDY

SEQ ID NO: 583 - protein, 12 aa, Artificial Sequence
  I3RB217 VL CDR1 (Exemplary)
RASQSVSSSYLA

SEQ ID NO: 584 - protein, 7 aa, Artificial Sequence
  I3RB217 VL CDR2 (Exemplary)
GASSRAT

SEQ ID NO: 585 - protein, 9 aa, Artificial Sequence
  I3RB217 VL CDR3 (Exemplary)
QQDYGFPWT

SEQ ID NO: 586 - protein, 8 aa, Artificial Sequence
  I3RB217 VH CDR1 (IMGT)
GYSFTSYW

SEQ ID NO: 587 - protein, 8 aa, Artificial Sequence
  I3RB217 VH CDR2 (IMGT)
IDPSDSDT

SEQ ID NO: 588 - protein, 11 aa, Artificial Sequence
  I3RB217 VH CDR3 (IMGT)
ARGDGSTDLDY

SEQ ID NO: 589 - protein, 7 aa, Artificial Sequence
  I3RB217 VL CDR1 (IMGT)
QSVSSSY

SEQ ID NO: 590 - protein, 3 aa, Artificial Sequence
  I3RB217 VL CDR2 (IMGT)
GAS

SEQ ID NO: 591 - protein, 9 aa, Artificial Sequence
  I3RB217 VL CDR3 (IMGT)
QQDYGFPWT

SEQ ID NO: 592 - protein, 5 aa, Artificial Sequence
  I3RB217 VH CDR1 (Kabat)
SYWIS

SEQ ID NO: 593 - protein, 17 aa, Artificial Sequence
  I3RB217 VH CDR2 (Kabat)
IIDPSDSDTRYSPSFQG

SEQ ID NO: 594 - protein, 9 aa, Artificial Sequence
  I3RB217 VH CDR3 (Kabat)
GDGSTDLDY

SEQ ID NO: 595 - protein, 12 aa, Artificial Sequence
  I3RB217 VL CDR1 (Kabat)
RASQSVSSSYLA

SEQ ID NO: 596 - protein, 7 aa, Artificial Sequence
  I3RB217 VL CDR2 (Kabat)
GASSRAT

SEQ ID NO: 597 - protein, 9 aa, Artificial Sequence
  I3RB217 VL CDR3 (Kabat)
QQDYGFPWT

SEQ ID NO: 598 - protein, 10 aa, Artificial Sequence
  I3RB217 VH CDR1 (Chothia v.1)
GYSFTSYWIS

SEQ ID NO: 599 - protein, 17 aa, Artificial Sequence
  I3RB217 VH CDR2 (Chothia v.1)
IIDPSDSDTRYSPSFQG

SEQ ID NO: 600 - protein, 9 aa, Artificial Sequence
  I3RB217 VH CDR3 (Chothia v.1)
GDGSTDLDY

SEQ ID NO: 601 - protein, 12 aa, Artificial Sequence
  I3RB217 VL CDR1 (Chothia v.1)
RASQSVSSSYLA

SEQ ID NO: 602 - protein, 7 aa, Artificial Sequence
  I3RB217 VL CDR2 (Chothia v.1)
GASSRAT

SEQ ID NO: 603 - protein, 9 aa, Artificial Sequence
  I3RB217 VL CDR3 (Chothia v.1)
QQDYGFPWT

SEQ ID NO: 604 - protein, 10 aa, Artificial Sequence
  I3RB217 VH CDR1 (Chothia v.2)
GYSFTSYWIS

SEQ ID NO: 605 - protein, 18 aa, Artificial Sequence
  I3RB217 VH CDR2 (Chothia v.2)
GIIDPSDSDTRYSPSFQG

SEQ ID NO: 606 - protein, 10 aa, Artificial Sequence
  I3RB217 VH CDR3 (Chothia v.2)
RGDGSTDLDY

SEQ ID NO: 607 - protein, 12 aa, Artificial Sequence
  I3RB217 VL CDR1 (Chothia v.2)
RASQSVSSSYLA

SEQ ID NO: 608 - protein, 7 aa, Artificial Sequence
  I3RB217 VL CDR2 (Chothia v.2)
GASSRAT

SEQ ID NO: 609 - protein, 9 aa, Artificial Sequence
  I3RB217 VL CDR3 (Chothia v.2)
QQDYGFPWT

SEQ ID NO: 610 - protein, 6 aa, Artificial Sequence
  I3RB217 VH CDR1 (Contact)
TSYWIS

SEQ ID NO: 611 - protein, 13 aa, Artificial Sequence
  I3RB217 VH CDR2 (Contact)
WMGIIDPSDSDTR

SEQ ID NO: 612 - protein, 10 aa, Artificial Sequence
  I3RB217 VH CDR3 (Contact)
ARGDGSTDLD

SEQ ID NO: 613 - protein, 8 aa, Artificial Sequence
  I3RB217 VL CDR1 (Contact)
SSSYLAWY

SEQ ID NO: 614 - protein, 10 aa, Artificial Sequence
  I3RB217 VL CDR2 (Contact)
LLIYGASSRA

SEQ ID NO: 615 - protein, 8 aa, Artificial Sequence
  I3RB217 VL CDR3 (Contact)
QQDYGFPW

SEQ ID NO: 616 - protein, 10 aa, Artificial Sequence
  I3RB217 VH CDR1 (AbM)
GYSFTSYWIS

SEQ ID NO: 617 - protein, 10 aa, Artificial Sequence
  I3RB217 VH CDR2 (AbM)
IIDPSDSDTR

SEQ ID NO: 618 - protein, 9 aa, Artificial Sequence
  I3RB217 VH CDR3 (AbM)
GDGSTDLDY

SEQ ID NO: 619 - protein, 12 aa, Artificial Sequence
  I3RB217 VL CDR1 (AbM)
RASQSVSSSYLA

SEQ ID NO: 620 - protein, 7 aa, Artificial Sequence
  I3RB217 VL CDR2 (AbM)
GASSRAT

SEQ ID NO: 621 - protein, 9 aa, Artificial Sequence
  I3RB217 VL CDR3 (AbM)
QQDYGFPWT

SEQ ID NO: 622 - protein, 10 aa, Artificial Sequence
  BCMB519 VH CDR1 (Exemplary)
GFTFSSYAMS

SEQ ID NO: 623 - protein, 17 aa, Artificial Sequence
  BCMB519 VH CDR2 (Exemplary)
AISGSGGSTYYADSVKG

SEQ ID NO: 624 - protein, 14 aa, Artificial Sequence
  BCMB519 VH CDR3 (Exemplary)
DEGYSSGHYYGMDV

SEQ ID NO: 625 - protein, 12 aa, Artificial Sequence
  BCMB519 VL CDR1 (Exemplary)
RASQSISSSFLT

SEQ ID NO: 626 - protein, 7 aa, Artificial Sequence
  BCMB519 VL CDR2 (Exemplary)
GASSRAT

SEQ ID NO: 627 - protein, 10 aa, Artificial Sequence
  BCMB519 VL CDR3 (Exemplary)
QHYGSSPMYT

SEQ ID NO: 628 - protein, 8 aa, Artificial Sequence
  BCMB519 VH CDR1 (IMGT)
GFTFSSYA

SEQ ID NO: 629 - protein, 8 aa, Artificial Sequence
  BCMB519 VH CDR2 (IMGT)
ISGSGGST

SEQ ID NO: 630 - protein, 16 aa, Artificial Sequence
  BCMB519 VH CDR3 (IMGT)
AKDEGYSSGHYYGMDV

SEQ ID NO: 631 - protein, 7 aa, Artificial Sequence
  BCMB519 VL CDR1 (IMGT)
QSISSSF

SEQ ID NO: 632 - protein, 3 aa, Artificial Sequence
  BCMB519 VL CDR2 (IMGT)
GAS

SEQ ID NO: 633 - protein, 10 aa, Artificial Sequence
  BCMB519 VL CDR3 (IMGT)
QHYGSSPMYT

SEQ ID NO: 634 - protein, 5 aa, Artificial Sequence
  BCMB519 VH CDR1 (Kabat)
SYAMS

SEQ ID NO: 635 - protein, 17 aa, Artificial Sequence
  BCMB519 VH CDR2 (Kabat)
AISGSGGSTYYADSVKG

SEQ ID NO: 636 - protein, 14 aa, Artificial Sequence
  BCMB519 VH CDR3 (Kabat)
DEGYSSGHYYGMDV

SEQ ID NO: 637 - protein, 12 aa, Artificial Sequence
  BCMB519 VL CDR1 (Kabat)
RASQSISSSFLT

SEQ ID NO: 638 - protein, 7 aa, Artificial Sequence
  BCMB519 VL CDR2 (Kabat)
GASSRAT

SEQ ID NO: 639 - protein, 10 aa, Artificial Sequence
  BCMB519 VL CDR3 (Kabat)
QHYGSSPMYT

SEQ ID NO: 640 - protein, 7 aa, Artificial Sequence
  BCMB519 VH CDR1 (Chothia v.1)
GFTFSSY

SEQ ID NO: 641 - protein, 4 aa, Artificial Sequence
  BCMB519 VH CDR2 (Chothia v.1)
GSGG

SEQ ID NO: 642 - protein, 12 aa, Artificial Sequence
  BCMB519 VH CDR3 (Chothia v.1)
EGYSSGHYYGMD

SEQ ID NO: 643 - protein, 8 aa, Artificial Sequence
  BCMB519 VL CDR1 (Chothia v.1)
SQSISSSF

SEQ ID NO: 644 - protein, 3 aa, Artificial Sequence
  BCMB519 VL CDR2 (Chothia v.1)
GAS

SEQ ID NO: 645 - protein, 7 aa, Artificial Sequence
  BCMB519 VL CDR3 (Chothia v.1)
YGSSPMY

SEQ ID NO: 646 - protein, 7 aa, Artificial Sequence
  BCMB519 VH CDR1 (Chothia v.2)
GFTFSSY

SEQ ID NO: 647 - protein, 5 aa, Artificial Sequence
  BCMB519 VH CDR2 (Chothia v.2)
SGSGG

SEQ ID NO: 648 - protein, 13 aa, Artificial Sequence
  BCMB519 VH CDR3 (Chothia v.2)
DEGYSSGHYYGMD

SEQ ID NO: 649 - protein, 8 aa, Artificial Sequence
  BCMB519 VL CDR1 (Chothia v.2)
SQSISSSF

SEQ ID NO: 650 - protein, 3 aa, Artificial Sequence
  BCMB519 VL CDR2 (Chothia v.2)
GAS

SEQ ID NO: 651 - protein, 7 aa, Artificial Sequence
  BCMB519 VL CDR3 (Chothia v.2)
YGSSPMY

SEQ ID NO: 652 - protein, 6 aa, Artificial Sequence
  BCMB519 VH CDR1 (Contact)
SSYAMS

SEQ ID NO: 653 - protein, 13 aa, Artificial Sequence
  BCMB519 VH CDR2 (Contact)
WVSAISGSGGSTY

SEQ ID NO: 654 - protein, 15 aa, Artificial Sequence
  BCMB519 VH CDR3 (Contact)
AKDEGYSSGHYYGMD

SEQ ID NO: 655 - protein, 8 aa, Artificial Sequence
  BCMB519 VL CDR1 (Contact)
SSSFLTWY

SEQ ID NO: 656 - protein, 10 aa, Artificial Sequence
  BCMB519 VL CDR2 (Contact)
LLIYGASSRA

SEQ ID NO: 657 - protein, 9 aa, Artificial Sequence
  BCMB519 VL CDR3 (Contact)
QHYGSSPMY

SEQ ID NO: 658 - protein, 10 aa, Artificial Sequence
  BCMB519 VH CDR1 (AbM)
GFTFSSYAMS

SEQ ID NO: 659 - protein, 10 aa, Artificial Sequence
  BCMB519 VH CDR2 (AbM)
AISGSGGSTY

SEQ ID NO: 660 - protein, 14 aa, Artificial Sequence
  BCMB519 VH CDR3 (AbM)
DEGYSSGHYYGMDV

SEQ ID NO: 661 - protein, 12 aa, Artificial Sequence
  BCMB519 VL CDR1 (AbM)
RASQSISSSFLT

SEQ ID NO: 662 - protein, 7 aa, Artificial Sequence
  BCMB519 VL CDR2 (AbM)
GASSRAT

SEQ ID NO: 663 - protein, 10 aa, Artificial Sequence
  BCMB519 VL CDR3 (AbM)
QHYGSSPMYT

SEQ ID NO: 664 - protein, 448 aa, Artificial Sequence
  Description of Artificial Sequence: Synthetic polypeptide
QVQLKESGPGLVAPSQSLSITCTVSGFSLTSYGVHWVRQPPGKGLEWLGIIWAGGGTNYNSALMSRLSITKDNSKSQVSLKMNSLQTDDTAMYYCARGTFFNYDYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPG

SEQ ID NO: 665 - protein, 214 aa, Artificial Sequence
  Description of Artificial Sequence: Synthetic polypeptide
DIVMTQSQKFMSTSVGDRVSITCKASQDVGTDVAWYQQKPGQSPKLMIYWASTRHTGVPDRFTGSGSGTDFTLTISNVQSEDLADYFCQQYSRYPWTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 666 - protein, 448 aa, Artificial Sequence
  Description of Artificial Sequence: Synthetic polypeptide
QVQLKESGPVLVAPSQSLSITCTVSGFSLTSYGVHWVRQPPGKGLEWLGIIWAGGNTNSNSALMSRLSISKDNSKSQVFLKMNSLQTDDTAMYYCARGSFYSYLYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPG

SEQ ID NO: 667 - protein, 214 aa, Artificial Sequence
  Description of Artificial Sequence: Synthetic polypeptide
DIVMTQSPSYLAASPGETITINCRASKSISKYLAWYQEKPGKTNKLLIYSGSTLQSGIPSRFSGSGSGTDFTLTISSLEPEDFAMYYCQQHNDYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 668 - protein, 450 aa, Artificial Sequence
  Description of Artificial Sequence: Synthetic polypeptide
DVQLQESGPGLVAPSQSLSITCTVSGFSLSSYAISWVRQPPGKGLEWLGVIWAGGGTNYNSALKSRLSISKDNSKSQVFLKMKSLQTDDTARYYCARNFFYDYDDGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 669 - protein, 219 aa, Artificial Sequence
  Description of Artificial Sequence: Synthetic polypeptide
NTQMNQTPLSLPVSLGDQASISCRSSQSLVHSNGNTYLHWYLQKPGQSPKLLIYKVSNRFSGVPDRFSGSGSGTDFTLKINRVEAEDLGVYFCSQSTHVPLTFGAGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 670 - protein, 449 aa, Artificial Sequence
  Description of Artificial Sequence: Synthetic polypeptide
QIQLVQSGPELKKPGETVKISCKASGYTFTNYGMNWVKQAPGKGLKWMGWINTYTGEPTYADDFKGRFAFSLETSASTAYLQINNLKNEDMATYFCARPYFGDYAMDYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 671 - protein, 214 aa, Artificial Sequence
  Description of Artificial Sequence: Synthetic polypeptide
DVQMIQSPASLSVSVGETVTITCRASENIYSNLAWYQQKQGKSPQVLVYTATNLADGVPSRFSGSGSGTQYSLKINSLQSEDFGSYYCQHFWGNPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 672 - protein, 450 aa, Artificial Sequence
  Description of Artificial Sequence: Synthetic polypeptide
QVQLQQSGPGLVAPSQSLSITCTVSGFSLTSYAISWIRQPPGKGLEWLGIIWAGGGTNYNSALKSRLSISKDNSKSQVFLKMNSLQIDDTARYYCARNPFYDYDEGLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 673 - protein, 219 aa, Artificial Sequence
  Description of Artificial Sequence: Synthetic polypeptide
DIVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 674 - protein, 449 aa, Artificial Sequence
  Description of Artificial Sequence: Synthetic polypeptide
QVQLKESGPVLVAPSQSLSITCTVSGFSLTSYGVHWIRQPPGKGLEWLGVIWAGGNTNYNSTLMSRLSISKDNSKSQVFLKMNSLQTDDTAMYYCARGSFYDYLYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - protein, 214 aa, Artificial Sequence
  Description of Artificial Sequence: Synthetic polypeptide
DIQMTQSPSYLAASPGETITINCRASKSISKYLAWYQEKPGKTNELLIYSGSTLQSGIPSRFSGSGSGTDFTLTISSLEPEDFAMYYCQQHNEYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 676 - protein, 16 aa, Artificial Sequence
  Vb17_N33S VL CDR1
RSSQSLVHSSGNTYLH

SEQ ID NO: 677 - protein, 112 aa, Artificial Sequence
  Vb17_N33S VL
DIQMTQSPSSLSASVGDRVTITCRSSQSLVHSSGNTYLHWYQQKPGKAPKFLIYKVSNRFSGVPSRFSGSGSGTDFTLTISSLQPEDFATYYCSQSTHVPFTFGQGTKLEIK

SEQ ID NO: 678 - protein, 16 aa, Artificial Sequence
  Vb17_N33S VL CDR1 (Exemplary)
RSSQSLVHSSGNTYLH

SEQ ID NO: 679 - protein, 11 aa, Artificial Sequence
  Vb17_N33S VL CDR1 (IMGT)
QSLVHSSGNTY

SEQ ID NO: 680 - protein, 16 aa, Artificial Sequence
  Vb17_N33S VL CDR1 (Kabat)
RSSQSLVHSSGNTYLH

SEQ ID NO: 681 - protein, 12 aa, Artificial Sequence
  Vb17_N33S VL CDR1 (Chothia v.1)
SQSLVHSSGNTY

SEQ ID NO: 682 - protein, 4 aa, Artificial Sequence
  Vb17_N33S VH CDR2 (Chothia v.2)
SYDG

SEQ ID NO: 683 - protein, 10 aa, Artificial Sequence
  Vb17_N33S VH CDR3 (Chothia v.2)
PSPGTGYAVD

SEQ ID NO: 684 - protein, 12 aa, Artificial Sequence
  Vb17_N33S VL CDR1 (Chothia v.2)
SQSLVHSSGNTY

SEQ ID NO: 685 - protein, 12 aa, Artificial Sequence
  Vb17_N33S VL CDR1 (Contact)
VHSSGNTYLHWY

SEQ ID NO: 686 - protein, 16 aa, Artificial Sequence
  Vb17_N33S VL CDR1 (AbM)
RSSQSLVHSSGNTYLH

SEQ ID NO: 687 - protein, 5 aa, Artificial Sequence
  Vb17_N33S VH CDR2 (Chothia v.3)
SYDGS

SEQ ID NO: 688 - protein, 473 aa, Artificial Sequence
  Recombinant human DLL3 (27-479) C-6xHis
AGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAHPGGGSGGGSGGGSHHHHHH

SEQ ID NO: 689 - protein, 14 aa, Artificial Sequence
  Linker
HPGGGSGGGSGGGS

SEQ ID NO: 690 - protein, 20 aa, Artificial Sequence
  Linker
GGSEGKSSGSGSESKSTGGS

SEQ ID NO: 691 - protein, 231 aa, Artificial Sequence
  Wild-type IgG1 Fc domain
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 692 - protein, 120 aa, Artificial Sequence
  DL3B279 scFv VH
QVQLVQSGAEVKKPGASVKVSCKASGNTFTNYYIHWVRQAPGQGLEWMGIINPSGGSTSYAQKLQGRMTMTRDTSTSTVYMELSSLRSEDTAVYFCARQGPFIGDAFDIWGQGTMVTVSS

SEQ ID NO: 693 - protein, 107 aa, Artificial Sequence
  DL3B279 scFv VL
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFAQGTKLEIK

SEQ ID NO: 694 - protein, 120 aa, Artificial Sequence
  DL3B279 scFv variant_VH
QVQLVQSGAEVKKPGASVKVSCKASGQTFTNYYIHWVRQAPGQGLEWMGIINPSGGSTSYAQKLQGRMTMTRDTSTSTVYMELSSLRSEDTAVYFCARQGPFIGDAFDIWGQGTTVTVSS

SEQ ID NO: 695 - protein, 107 aa, Artificial Sequence
  DL3B279 scFv variant_VL
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKLEIK

SEQ ID NO: 696 - protein, 5 aa, Artificial Sequence
  DL3B279 scFv of Kabat HCDR1
NYYIH

SEQ ID NO: 697 - protein, 17 aa, Artificial Sequence
  DL3B279 scFv of Kabat HCDR2
IINPSGGSTSYAQKLQG

SEQ ID NO: 698 - protein, 11 aa, Artificial Sequence
  DL3B279 scFv of Kabat HCDR3
QGPFIGDAFDI

SEQ ID NO: 699 - protein, 11 aa, Artificial Sequence
  DL3B279 scFv of Kabat LCDR1
RASQGISNYLA

SEQ ID NO: 700 - protein, 7 aa, Artificial Sequence
  DL3B279 scFv of Kabat LCDR2
AASSLQS

SEQ ID NO: 701 - protein, 9 aa, Artificial Sequence
  DL3B279 scFv of Kabat LCDR3
QQYNSYPYT

SEQ ID NO: 702 - DNA, 360 bp, Artificial Sequence
  DL3B279 scFv-VH cDNA
caggttcagttggtccagagtggtgccgaagtaaagaagcccggagcatccgtaaaggtgtcctgtaaagccagtggcaatactttcactaactattacatccattgggtccgacaagcccccggacaaggattggagtggatgggtattatcaacccctccggtgggtctacttcttacgctcaaaaactccagggccgaatgacaatgacacgcgacacctcaacttcaaccgtttacatggagcttagcagtcttcgatctgaggacactgctgtttacttttgcgctaggcaggggcctttcataggagacgcttttgacatctgggggcaaggaacaatggtcactgtcagttcc

SEQ ID NO: 703 - DNA, 360 bp, Artificial Sequence
  DL3B279 scFv variant -VH cDNA
caggttcagctggttcagtctggcgccgaagtgaagaaacctggcgcctctgtgaaggtgtcctgcaaggcttctggacagaccttcaccaactactacatccactgggtccgacaggcccctggacaaggattggagtggatgggcatcatcaacccttccggcggctctacctcttacgcccagaaactgcagggcagaatgaccatgaccagagacacctccaccagcaccgtgtacatggaactgtccagcctgagatccgaggataccgccgtgtacttctgtgccagacagggaccttttatcggcgacgccttcgacatctggggccagggaacaacagtgaccgtgtcctct

SEQ ID NO: 704 - DNA, 321 bp, Artificial Sequence
  DL3B279 scFv-VL cDNA
gatattcagatgacacagtctccatccagcttgtcagcaagcgtgggtgatagggttaccatcacttgtcgcgcaagtcaaggaattagtaactatttggcatggtttcagcagaaacccggtaaggctccaaaatcactcatatatgcagcatcctccctccagtctggtgttccaagtaagttttccgggagcggttccggcaccgatttcactctcacaatctctagccttcaacccgaggacttcgctacctattattgccaacagtataatagctacccatacacttttgctcaagggaccaaactcgagatcaaa

SEQ ID NO: 705 - DNA, 321 bp, Artificial Sequence
  DL3B279 scFv variant -VL cDNA
gacatccagatgacccagtctccatcctctctgtccgcctctgtgggcgacagagtgaccatcacctgtagagcctctcagggcatctccaactacctggcctggttccagcagaagcctggcaaggctcccaagagcctgatctacgctgcttccagtctgcagtctggcgtgccctctaagttctccggctctggctctggcaccgactttaccctgacaatctccagcctgcagcctgaggacttcgccacctactactgccagcagtacaacagctacccctacacctttggccagggcaccaagctggaaatcaag

SEQ ID NO: 706 - protein, 20 aa, Artificial Sequence
  Linker
GGSEGKSSGSGSESKSTGGS

SEQ ID NO: 707 - protein, 247 aa, Artificial Sequence
  DL3B279 scFv_LH
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFAQGTKLEIKGGSEGKSSGSGSESKSTGGSQVQLVQSGAEVKKPGASVKVSCKASGNTFTNYYIHWVRQAPGQGLEWMGIINPSGGSTSYAQKLQGRMTMTRDTSTSTVYMELSSLRSEDTAVYFCARQGPFIGDAFDIWGQGTMVTVSS

SEQ ID NO: 708 - protein, 247 aa, Artificial Sequence
  DL3B279 scFv_LH (variant)
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKLEIKGGSEGKSSGSGSESKSTGGSQVQLVQSGAEVKKPGASVKVSCKASGQTFTNYYIHWVRQAPGQGLEWMGIINPSGGSTSYAQKLQGRMTMTRDTSTSTVYMELSSLRSEDTAVYFCARQGPFIGDAFDIWGQGTTVTVSS

SEQ ID NO: 709 - protein, 247 aa, Artificial Sequence
  DL3B279 scFv_HL
QVQLVQSGAEVKKPGASVKVSCKASGNTFTNYYIHWVRQAPGQGLEWMGIINPSGGSTSYAQKLQGRMTMTRDTSTSTVYMELSSLRSEDTAVYFCARQGPFIGDAFDIWGQGTMVTVSSGGSEGKSSGSGSESKSTGGSDIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFAQGTKLEIK

SEQ ID NO: 710 - protein, 247 aa, Artificial Sequence
  DL3B279 scFv variant_HL
QVQLVQSGAEVKKPGASVKVSCKASGQTFTNYYIHWVRQAPGQGLEWMGIINPSGGSTSYAQKLQGRMTMTRDTSTSTVYMELSSLRSEDTAVYFCARQGPFIGDAFDIWGQGTTVTVSSGGSEGKSSGSGSESKSTGGSDIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKLEIK

SEQ ID NO: 711 - DNA, 741 bp, Artificial Sequence
  DL3B279-scFv-LH DNA
gatatacaaatgactcaaagtccctctagtctcagtgcttccgttggggatagggtaactatcacttgccgcgctagtcaaggcatctcaaattatttggcatggttccaacagaagcctggtaaggcaccaaaatcactcatctacgctgctagttctctgcaatcaggtgtgccatccaaattctcaggcagtgggtctgggacagactttaccctcaccataagttctctccaacctgaggattttgcaacatactattgtcagcagtataatagttatccatacacattcgcacaaggtactaaactggaaatcaagggcggctccgagggcaagagcagcggcagcggcagcgagagcaagagcaccggcggcagccaagttcaacttgtccaaagtggagctgaagtgaagaaaccaggggcaagcgtcaaagtatcatgtaaagccagcggaaacactttcaccaactactacattcattgggtaaggcaggcaccaggacaaggcttggaatggatgggtattataaacccttcaggtggcagtacatcctatgcccaaaaactgcaaggtcggatgaccatgactcgtgacacttcaacttctactgtttatatggagctttcatccctgcgatccgaagatacagccgtgtatttttgtgctcgccaggggcctttcatcggagatgccttcgatatatggggtcaaggcacaatggtaactgtgtcaagc

SEQ ID NO: 712 - DNA, 741 bp, Artificial Sequence
  DL3B279-scFv-LH variant DNA
gacatccagatgacccagtctccatcctctctgtccgcctctgtgggcgacagagtgaccatcacctgtagagcctctcagggcatctccaactacctggcctggttccagcagaagcctggcaaggctcccaagagcctgatctacgctgcttccagtctgcagtctggcgtgccctctaagttctccggctctggctctggcaccgactttaccctgacaatctccagcctgcagcctgaggacttcgccacctactactgccagcagtacaacagctacccctacacctttggccagggcaccaagctggaaatcaagggcggctccgagggcaagagcagcggcagcggcagcgagagcaagagcaccggcggcagccaggttcagctggttcagtctggcgccgaagtgaagaaacctggcgcctctgtgaaggtgtcctgcaaggcttctggacagaccttcaccaactactacatccactgggtccgacaggcccctggacaaggattggagtggatgggcatcatcaacccttccggcggctctacctcttacgcccagaaactgcagggcagaatgaccatgaccagagacacctccaccagcaccgtgtacatggaactgtccagcctgagatccgaggataccgccgtgtacttctgtgccagacagggaccttttatcggcgacgccttcgacatctggggccagggaacaacagtgaccgtgtcctct

SEQ ID NO: 713 - DNA, 360 bp, Artificial Sequence
  Vb17-v2-B17B21-Fab VH DNA
caagtgcagcttcaggaatctggacccggattggttaagcccagtgaaaccctcagtttgacctgtactgtgagcggttattccataactagcggctacttctggaattggatccgacagcctccaggtaaagggcttgagtggattggctacattagctacgatggctccaacaactataatccaagtttgaaaagtagagtgaccatcagcagagatacttccaaaaatcagttcagtcttaaacttagctccgtgacagccgccgacacagccgtttactactgtgcaagcccatctccaggtactggatatgccgtagattattggggacaaggtactcttgtgactgtgtccagt

SEQ ID NO: 714 - DNA, 336 bp, Artificial Sequence
  Vb17-v2-B17B21-Fab VL DNA
gacatccagatgacccagagccccagcagcctgtctgccagcgtgggcgacagagtgaccatcacctgtcggagcagccagagcctggtgcacagcaacggcaacacctacctgcactggtatcagcagaagcccggcaaggcccccaagttcctgatctacaaggtgtccaaccggttcagcggcgtgcccagcagattttctggcagcggctccggcaccgacttcaccctgacaatcagctccctgcagcccgaggacttcgccacctactactgcagccagtccacccacgtgcccttcacctttggccagggcaccaagctggaaatcaag

SEQ ID NO: 715 - DNA, 360 bp, Artificial Sequence
  Vb17-LC-N33S- Fab VH DNA
caggttcagctgcaagagtctggccctggcctggtcaagccttccgagacactgtctctgacctgcaccgtgtccggctactctatcaccagcggctacttttggaactggatccggcagcctcctggcaaaggcctggaatggatcggctacatctcctacgacggctccaacaactacaaccccagcctgaagtccagagtgaccatctctcgggacacctccaagaaccagttctccctgaagctgtcctccgtgaccgctgctgataccgccgtgtactactgcgcctctccttctcctggcaccggctacgctgtggattattggggacagggcaccctcgtgaccgtgtcatct

SEQ ID NO: 716 - DNA, 336 bp, Artificial Sequence
  Vb17-LC-N33S- Fab VL DNA
gacatccagatgacccagtctccatcctctctgtccgcctctgtgggcgacagagtgaccatcacctgtcggtcctctcagtccctggtgcactcttccggcaacacctacctgcactggtatcagcagaagcccggcaaggcccctaagttcctgatctacaaggtgtccaaccggttctccggcgtgccctccagattttctggctctggatctggcaccgactttaccctgacaatctccagcctgcagcctgaggacttcgccacctactactgctcccagtctacccacgtgccattcacctttggccagggcaccaagctggaaatcaag

SEQ ID NO: 717 - protein, 6 aa, Artificial Sequence
  Vb17_v2-B17B21-Fab and Vb17-LC-N33S-Fab of HCDR1
SGYFWN

SEQ ID NO: 718 - protein, 476 aa, Artificial Sequence
  DL3B279-LH-scFv-Fc
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFAQGTKLEIKGGSEGKSSGSGSESKSTGGSQVQLVQSGAEVKKPGASVKVSCKASGNTFTNYYIHWVRQAPGQGLEWMGIINPSGGSTSYAQKLQGRMTMTRDTSTSTVYMELSSLRSEDTAVYFCARQGPFIGDAFDIWGQGTMVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLS

SEQ ID NO: 719 - protein, 479 aa, Artificial Sequence
  DL3B279-VL-A99G-VH-N27Q_M105T-LH-scFV-Fc (variant)
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKLEIKGGSEGKSSGSGSESKSTGGSQVQLVQSGAEVKKPGASVKVSCKASGQTFTNYYIHWVRQAPGQGLEWMGIINPSGGSTSYAQKLQGRMTMTRDTSTSTVYMELSSLRSEDTAVYFCARQGPFIGDAFDIWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 720 - protein, 449 aa, Artificial Sequence
  Vb17_v2-B17B21-Fab of HC2
QVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPG

SEQ ID NO: 721 - protein, 218 aa, Artificial Sequence
  Vb17_v2-B17B21-Fab of LC2
DIQMTQSPSSLSASVGDRVTITCRSSQSLVHSNGNTYLHWYQQKPGKAPKFLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 722 - protein, 450 aa, Artificial Sequence
  Vb17-LC-N33S-Fab of HC2
QVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 723 - protein, 219 aa, Artificial Sequence
  Vb17-LC-N33S-Fab of LC2
DIQMTQSPSSLSASVGDRVTITCRSSQSLVHSSGNTYLHWYQQKPGKAPKFLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 724 - DNA, 1434 bp, Artificial Sequence
  DL3B279 LH scFv-Fc cDNA
gatattcagatgacacagtctccatccagcttgtcagcaagcgtgggtgatagggttaccatcacttgtcgcgcaagtcaaggaattagtaactatttggcatggtttcagcagaaacccggtaaggctccaaaatcactcatatatgcagcatcctccctccagtctggtgttccaagtaagttttccgggagcggttccggcaccgatttcactctcacaatctctagccttcaacccgaggacttcgctacctattattgccaacagtataatagctacccatacacttttgctcaagggaccaaactcgagatcaaaggcggctccgagggcaagagcagcggcagcggcagcgagagcaagagcaccggcggcagccaggttcagttggtccagagtggtgccgaagtaaagaagcccggagcatccgtaaaggtgtcctgtaaagccagtggcaatactttcactaactattacatccattgggtccgacaagcccccggacaaggattggagtggatgggtattatcaacccctccggtgggtctacttcttacgctcaaaaactccagggccgaatgacaatgacacgcgacacctcaacttcaaccgtttacatggagcttagcagtcttcgatctgaggacactgctgtttacttttgcgctaggcaggggcctttcataggagacgcttttgacatctgggggcaaggaacaatggtcactgtcagttccgagcccaaatctagcgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 725 - DNA, 1437 bp, Artificial Sequence
  DL3B279 LH scFv variant-Fc cDNA
gacatccagatgacccagtctccatcctctctgtccgcctctgtgggcgacagagtgaccatcacctgtagagcctctcagggcatctccaactacctggcctggttccagcagaagcctggcaaggctcccaagagcctgatctacgctgcttccagtctgcagtctggcgtgccctctaagttctccggctctggctctggcaccgactttaccctgacaatctccagcctgcagcctgaggacttcgccacctactactgccagcagtacaacagctacccctacacctttggccagggcaccaagctggaaatcaagggcggctccgagggcaagagcagcggcagcggcagcgagagcaagagcaccggcggcagccaggttcagctggttcagtctggcgccgaagtgaagaaacctggcgcctctgtgaaggtgtcctgcaaggcttctggacagaccttcaccaactactacatccactgggtccgacaggcccctggacaaggattggagtggatgggcatcatcaacccttccggcggctctacctcttacgcccagaaactgcagggcagaatgaccatgaccagagacacctccaccagcaccgtgtacatggaactgtccagcctgagatccgaggataccgccgtgtacttctgtgccagacagggaccttttatcggcgacgccttcgacatctggggccagggaacaacagtgaccgtgtcctctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 726 - DNA, 1347 bp, Artificial Sequence
  Vb17_v2-B17B21-Fab HC cDNA
caagtgcagcttcaggaatctggacccggattggttaagcccagtgaaaccctcagtttgacctgtactgtgagcggttattccataactagcggctacttctggaattggatccgacagcctccaggtaaagggcttgagtggattggctacattagctacgatggctccaacaactataatccaagtttgaaaagtagagtgaccatcagcagagatacttccaaaaatcagttcagtcttaaacttagctccgtgacagccgccgacacagccgtttactactgtgcaagcccatctccaggtactggatatgccgtagattattggggacaaggtactcttgtgactgtgtccagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtctagatggcagcaggggaacgtcttctcatgctccgtgatgcatgaggctctgcacaaccactacacgcagaagagcctctccctgtctccgggt

SEQ ID NO: 727 - DNA, 657 bp, Artificial Sequence
  Vb17_v2-B17B21-Fab LC cDNA
gacatccagatgacccagagccccagcagcctgtctgccagcgtgggcgacagagtgaccatcacctgtcggagcagccagagcctggtgcacagcaacggcaacacctacctgcactggtatcagcagaagcccggcaaggcccccaagttcctgatctacaaggtgtccaaccggttcagcggcgtgcccagcagattttctggcagcggctccggcaccgacttcaccctgacaatcagctccctgcagcccgaggacttcgccacctactactgcagccagtccacccacgtgcccttcacctttggccagggcaccaagctggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 728 - DNA, 1350 bp, Artificial Sequence
  Vb17-LC-N33S-Fab HC cDNA
caggttcagctgcaagagtctggccctggcctggtcaagccttccgagacactgtctctgacctgcaccgtgtccggctactctatcaccagcggctacttttggaactggatccggcagcctcctggcaaaggcctggaatggatcggctacatctcctacgacggctccaacaactacaaccccagcctgaagtccagagtgaccatctctcgggacacctccaagaaccagttctccctgaagctgtcctccgtgaccgctgctgataccgccgtgtactactgcgcctctccttctcctggcaccggctacgctgtggattattggggacagggcaccctcgtgaccgtgtcatctgcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgtaccccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcgccctcgtgagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 729 - DNA, 657 bp, Artificial Sequence
  Vb17-LC-N33S-Fab cDNA
gacatccagatgacccagagccccagcagcctgtctgccagcgtgggcgacagagtgaccatcacctgtcggagcagccagagcctggtgcacagctctggcaacacctacctgcactggtatcagcagaagcccggcaaggcccccaagttcctgatctacaaggtgtccaaccggttcagcggcgtgcccagcagattttctggcagcggctccggcaccgacttcaccctgacaatcagctccctgcagcccgaggacttcgccacctactactgcagccagtccacccacgtgcccttcacctttggccagggcaccaagctggaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 730 - protein, 121 aa, Artificial Sequence
  Description of Artificial Sequence: Synthetic polypeptide
EVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDGVGATPYYFDYWGQGTLVTVSS

SEQ ID NO: 731 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVL

SEQ ID NO: 732 - protein, 121 aa, Artificial Sequence; identical to SEQ ID NO: 730
  Description of Artificial Sequence: Synthetic polypeptide

SEQ ID NO: 733 - protein, 110 aa, Artificial Sequence
  Description of Artificial Sequence: Synthetic polypeptide
QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVL

SEQ ID NO: 734 - protein, 121 aa, Artificial Sequence
  Description of Artificial Sequence: Synthetic polypeptide
EVQLVESGGGLVQPGGSLRLSCAASGFTFSSYAMSWVRQAPGKGLEWVSAISGGSGSTYYADSVKGRFTISRDNSKNTLYLQMNSLRAEDSAVYYCAKDGVGATPYYFDYWGQGTLVTVSS

SEQ ID NO: 735 - protein, 110 aa, Artificial Sequence; identical to SEQ ID NO: 731
  Description of Artificial Sequence: Synthetic polypeptide

SEQ ID NO: 736 - protein, 121 aa, Artificial Sequence; identical to SEQ ID NO: 734
  Description of Artificial Sequence: Synthetic polypeptide

SEQ ID NO: 737 - protein, 110 aa, Artificial Sequence; identical to SEQ ID NO: 733
  Description of Artificial Sequence: Synthetic polypeptide

SEQ ID NO: 738 - protein, 5 aa, Artificial Sequence
  Description of Artificial Sequence: Synthetic peptide
SYAMS

SEQ ID NO: 739 - protein, 17 aa, Artificial Sequence
  Description of Artificial Sequence: Synthetic peptide
AISGGIGSTYYADSVKG

SEQ ID NO: 740 - protein, 12 aa, Artificial Sequence
  Description of Artificial Sequence: Synthetic peptide
DGVGATPYYFDY

SEQ ID NO: 741 - protein, 13 aa, Artificial Sequence
  Description of Artificial Sequence: Synthetic peptide
SGSSSNIGNNYVS

SEQ ID NO: 742 - protein, 7 aa, Artificial Sequence
  Description of Artificial Sequence: Synthetic peptide
DNNKRPS

SEQ ID NO: 743 - protein, 11 aa, Artificial Sequence
  Description of Artificial Sequence: Synthetic peptide
GTWDSSLSAYV

SEQ ID NO: 744 - protein, 5 aa, Artificial Sequence
  Description of Artificial Sequence: Synthetic peptide
SYAMS

SEQ ID NO: 745 - protein, 17 aa, Artificial Sequence
  Description of Artificial Sequence: Synthetic peptide
AISGGIGSTYYADSVKG

SEQ ID NO: 746 - protein, 12 aa, Artificial Sequence
  Description of Artificial Sequence: Synthetic peptide
DGVGATPYYFDY

SEQ ID NO: 747 - protein, 13 aa, Artificial Sequence
  Description of Artificial Sequence: Synthetic peptide
SGSSSNIGINYVS

SEQ ID NO: 748 - protein, 7 aa, Artificial Sequence
  Description of Artificial Sequence: Synthetic peptide
DNNKRPS

SEQ ID NO: 749 - protein, 11 aa, Artificial Sequence
  Description of Artificial Sequence: Synthetic peptide
GTWDSSLSAVV

SEQ ID NO: 750 - protein, 5 aa, Artificial Sequence
  Description of Artificial Sequence: Synthetic peptide
SYAMS

SEQ ID NO: 751 - protein, 17 aa, Artificial Sequence
  Description of Artificial Sequence: Synthetic peptide
AISGGSGSTYYADSVKG

SEQ ID NO: 752 - protein, 12 aa, Artificial Sequence
  Description of Artificial Sequence: Synthetic peptide
DGVGATPYYFDY

SEQ ID NO: 753 - protein, 13 aa, Artificial Sequence
  Description of Artificial Sequence: Synthetic peptide
SGSSSNIGNNYVS

SEQ ID NO: 754 - protein, 7 aa, Artificial Sequence
  Description of Artificial Sequence: Synthetic peptide
DNNKRPS

SEQ ID NO: 755 - protein, 11 aa, Artificial Sequence
  Description of Artificial Sequence: Synthetic peptide
GTWDSSLSAYV

SEQ ID NO: 756 - protein, 5 aa, Artificial Sequence
  Description of Artificial Sequence: Synthetic peptide
SYAMS

SEQ ID NO: 757 - protein, 17 aa, Artificial Sequence
  Description of Artificial Sequence: Synthetic peptide
AISGGSGSTYYADSVKG

SEQ ID NO: 758 - protein, 12 aa, Artificial Sequence
  Description of Artificial Sequence: Synthetic peptide
DGVGATPYYFDY

SEQ ID NO: 759 - protein, 13 aa, Artificial Sequence
  Description of Artificial Sequence: Synthetic peptide
SGSSSNIGINYVS

SEQ ID NO: 760 - protein, 7 aa, Artificial Sequence
  Description of Artificial Sequence: Synthetic peptide
DNNKRPS

SEQ ID NO: 761 - protein, 11 aa, Artificial Sequence
  Description of Artificial Sequence: Synthetic peptide
GTWDSSLSAVV

SEQ ID NO: 762 - protein, 7 aa, Artificial Sequence
  Description of Artificial Sequence: Synthetic peptide
GFTFSSY

SEQ ID NO: 763 - protein, 6 aa, Artificial Sequence
  Description of Artificial Sequence: Synthetic peptide
SGGIGS

SEQ ID NO: 764 - protein, 10 aa, Artificial Sequence
  Description of Artificial Sequence: Synthetic peptide
GVGATPYYFD

SEQ ID NO: 765 - protein, 9 aa, Artificial Sequence
  Description of Artificial Sequence: Synthetic peptide
SSSNIGNNY

SEQ ID NO: 766 - protein, 3 aa, Artificial Sequence
  Description of Artificial Sequence: Synthetic peptide
DNN

SEQ ID NO: 767 - protein, 8 aa, Artificial Sequence
  Description of Artificial Sequence: Synthetic peptide
WDSSLSAY

SEQ ID NO: 768 - protein, 7 aa, Artificial Sequence
  Description of Artificial Sequence: Synthetic peptide
GFTFSSY

SEQ ID NO: 769 - protein, 6 aa, Artificial Sequence
  Description of Artificial Sequence: Synthetic peptide
SGGIGS

SEQ ID NO: 770 - protein, 10 aa, Artificial Sequence
  Description of Artificial Sequence: Synthetic peptide
GVGATPYYFD

SEQ ID NO: 771 - protein, 9 aa, Artificial Sequence
  Description of Artificial Sequence: Synthetic peptide
SSSNIGINY

SEQ ID NO: 772 - protein, 3 aa, Artificial Sequence
  Description of Artificial Sequence: Synthetic peptide
DNN

SEQ ID NO: 773 - protein, 8 aa, Artificial Sequence
  Description of Artificial Sequence: Synthetic peptide
WDSSLSAV

SEQ ID NO: 774 - protein, 7 aa, Artificial Sequence
  Description of Artificial Sequence: Synthetic peptide
GFTFSSY

SEQ ID NO: 775 - protein, 6 aa, Artificial Sequence
  Description of Artificial Sequence: Synthetic peptide
SGGSGS

SEQ ID NO: 776 - protein, 10 aa, Artificial Sequence
  Description of Artificial Sequence: Synthetic peptide
GVGATPYYFD

SEQ ID NO: 777 - protein, 9 aa, Artificial Sequence
  Description of Artificial Sequence: Synthetic peptide
SSSNIGNNY

SEQ ID NO: 778 - protein, 3 aa, Artificial Sequence
  Description of Artificial Sequence: Synthetic peptide
DNN

SEQ ID NO: 779 - protein, 8 aa, Artificial Sequence
  Description of Artificial Sequence: Synthetic peptide
WDSSLSAY

SEQ ID NO: 780 - protein, 7 aa, Artificial Sequence
  Description of Artificial Sequence: Synthetic peptide
GFTFSSY

SEQ ID NO: 781 - protein, 6 aa, Artificial Sequence
  Description of Artificial Sequence: Synthetic peptide
SGGSGS

SEQ ID NO: 782 - protein, 10 aa, Artificial Sequence
  Description of Artificial Sequence: Synthetic peptide
GVGATPYYFD

SEQ ID NO: 783 - protein, 9 aa, Artificial Sequence
  Description of Artificial Sequence: Synthetic peptide
SSSNIGINY

SEQ ID NO: 784 - protein, 3 aa, Artificial Sequence
  Description of Artificial Sequence: Synthetic peptide
DNN

SEQ ID NO: 785 - protein, 8 aa, Artificial Sequence
  Description of Artificial Sequence: Synthetic peptide
WDSSLSAV

SEQ ID NO: 786 - protein, 10 aa, Artificial Sequence
  Description of Artificial Sequence: Synthetic peptide
GFTFSSYAMS

SEQ ID NO: 787 - protein, 10 aa, Artificial Sequence
  Description of Artificial Sequence: Synthetic peptide
AISGGIGSTY

SEQ ID NO: 788 - protein, 12 aa, Artificial Sequence
  Description of Artificial Sequence: Synthetic peptide
DGVGATPYYFDY

SEQ ID NO: 789 - protein, 13 aa, Artificial Sequence
  Description of Artificial Sequence: Synthetic peptide
SGSSSNIGNNYVS

SEQ ID NO: 790 - protein, 7 aa, Artificial Sequence
  Description of Artificial Sequence: Synthetic peptide
DNNKRPS

SEQ ID NO: 791 - protein, 11 aa, Artificial Sequence
  Description of Artificial Sequence: Synthetic peptide
GTWDSSLSAYV

SEQ ID NO: 792 - protein, 10 aa, Artificial Sequence
  Description of Artificial Sequence: Synthetic peptide
GFTFSSYAMS

SEQ ID NO: 793 - protein, 10 aa, Artificial Sequence
  Description of Artificial Sequence: Synthetic peptide
AISGGIGSTY

SEQ ID NO: 794 - protein, 12 aa, Artificial Sequence
  Description of Artificial Sequence: Synthetic peptide
DGVGATPYYFDY

SEQ ID NO: 795 - protein, 13 aa, Artificial Sequence
  Description of Artificial Sequence: Synthetic peptide
SGSSSNIGINYVS

SEQ ID NO: 796 - protein, 7 aa, Artificial Sequence
  Description of Artificial Sequence: Synthetic peptide
DNNKRPS

SEQ ID NO: 797 - protein, 11 aa, Artificial Sequence
  Description of Artificial Sequence: Synthetic peptide
GTWDSSLSAVV

SEQ ID NO: 798 - protein, 10 aa, Artificial Sequence
  Description of Artificial Sequence: Synthetic peptide
GFTFSSYAMS

SEQ ID NO: 799 - protein, 10 aa, Artificial Sequence
  Description of Artificial Sequence: Synthetic peptide
AISGGSGSTY

SEQ ID NO: 800 - protein, 12 aa, Artificial Sequence
  Description of Artificial Sequence: Synthetic peptide
DGVGATPYYFDY

SEQ ID NO: 801 - protein, 13 aa, Artificial Sequence
  Description of Artificial Sequence: Synthetic peptide
SGSSSNIGNNYVS

SEQ ID NO: 802 - protein, 7 aa, Artificial Sequence
  Description of Artificial Sequence: Synthetic peptide
DNNKRPS

SEQ ID NO: 803 - protein, 11 aa, Artificial Sequence
  Description of Artificial Sequence: Synthetic peptide
GTWDSSLSAYV

SEQ ID NO: 804 - protein, 10 aa, Artificial Sequence
  Description of Artificial Sequence: Synthetic peptide
GFTFSSYAMS

SEQ ID NO: 805 - protein, 10 aa, Artificial Sequence
  Description of Artificial Sequence: Synthetic peptide
AISGGSGSTY

SEQ ID NO: 806 - protein, 12 aa, Artificial Sequence
  Description of Artificial Sequence: Synthetic peptide
DGVGATPYYFDY

SEQ ID NO: 807 - protein, 13 aa, Artificial Sequence
  Description of Artificial Sequence: Synthetic peptide
SGSSSNIGINYVS

SEQ ID NO: 808 - protein, 7 aa, Artificial Sequence
  Description of Artificial Sequence: Synthetic peptide
DNNKRPS

SEQ ID NO: 809 - protein, 11 aa, Artificial Sequence
  Description of Artificial Sequence: Synthetic peptide
GTWDSSLSAVV

SEQ ID NO: 810 - protein, 6 aa, Artificial Sequence
  Description of Artificial Sequence: Synthetic peptide
SSYAMS

SEQ ID NO: 811 - protein, 13 aa, Artificial Sequence
  Description of Artificial Sequence: Synthetic peptide
WVSAISGGIGSTY

SEQ ID NO: 812 - protein, 13 aa, Artificial Sequence
  Description of Artificial Sequence: Synthetic peptide
AKDGVGATPYYFD

SEQ ID NO: 813 - protein, 9 aa, Artificial Sequence
  Description of Artificial Sequence: Synthetic peptide
IGNNYVSWY

SEQ ID NO: 814 - protein, 10 aa, Artificial Sequence
  Description of Artificial Sequence: Synthetic peptide
LLIYDNNKRP

SEQ ID NO: 815 - protein, 10 aa, Artificial Sequence
  Description of Artificial Sequence: Synthetic peptide
GTWDSSLSAY

SEQ ID NO: 816 - protein, 6 aa, Artificial Sequence
  Description of Artificial Sequence: Synthetic peptide
SSYAMS

SEQ ID NO: 817 - protein, 13 aa, Artificial Sequence
  Description of Artificial Sequence: Synthetic peptide
WVSAISGGIGSTY

SEQ ID NO: 818 - protein, 13 aa, Artificial Sequence
  Description of Artificial Sequence: Synthetic peptide
AKDGVGATPYYFD

SEQ ID NO: 819 - protein, 9 aa, Artificial Sequence
  Description of Artificial Sequence: Synthetic peptide
IGINYVSWY

SEQ ID NO: 820 - protein, 10 aa, Artificial Sequence
  Description of Artificial Sequence: Synthetic peptide
LLIYDNNKRP

SEQ ID NO: 821 - protein, 10 aa, Artificial Sequence
  Description of Artificial Sequence: Synthetic peptide
GTWDSSLSAV

SEQ ID NO: 822 - protein, 6 aa, Artificial Sequence
  Description of Artificial Sequence: Synthetic peptide
SSYAMS

SEQ ID NO: 823 - protein, 13 aa, Artificial Sequence
  Description of Artificial Sequence: Synthetic peptide
WVSAISGGSGSTY

SEQ ID NO: 824 - protein, 13 aa, Artificial Sequence
  Description of Artificial Sequence: Synthetic peptide
AKDGVGATPYYFD

SEQ ID NO: 825 - protein, 9 aa, Artificial Sequence
  Description of Artificial Sequence: Synthetic peptide
IGNNYVSWY

SEQ ID NO: 826 - protein, 10 aa, Artificial Sequence
  Description of Artificial Sequence: Synthetic peptide
LLIYDNNKRP

SEQ ID NO: 827 - protein, 10 aa, Artificial Sequence
  Description of Artificial Sequence: Synthetic peptide
GTWDSSLSAY

SEQ ID NO: 828 - protein, 6 aa, Artificial Sequence
  Description of Artificial Sequence: Synthetic peptide
SSYAMS

SEQ ID NO: 829 - protein, 13 aa, Artificial Sequence
  Description of Artificial Sequence: Synthetic peptide
WVSAISGGSGSTY

SEQ ID NO: 830 - protein, 13 aa, Artificial Sequence
  Description of Artificial Sequence: Synthetic peptide
AKDGVGATPYYFD

SEQ ID NO: 831 - protein, 9 aa, Artificial Sequence
  Description of Artificial Sequence: Synthetic peptide
IGINYVSWY

SEQ ID NO: 832 - protein, 10 aa, Artificial Sequence
  Description of Artificial Sequence: Synthetic peptide
LLIYDNNKRP

SEQ ID NO: 833 - protein, 10 aa, Artificial Sequence
  Description of Artificial Sequence: Synthetic peptide
GTWDSSLSAV

SEQ ID NO: 834 - protein, 8 aa, Artificial Sequence
  Description of Artificial Sequence: Synthetic peptide
GFTFSSYA

SEQ ID NO: 835 - protein, 8 aa, Artificial Sequence
  Description of Artificial Sequence: Synthetic peptide
ISGGIGST

SEQ ID NO: 836 - protein, 14 aa, Artificial Sequence
  Description of Artificial Sequence: Synthetic peptide
AKDGVGATPYYFDY

SEQ ID NO: 837 - protein, 8 aa, Artificial Sequence
  Description of Artificial Sequence: Synthetic peptide
SSNIGNNY

SEQ ID NO: 838 - protein, 3 aa, Artificial Sequence
  Description of Artificial Sequence: Synthetic peptide
DNN

SEQ ID NO: 839 - protein, 11 aa, Artificial Sequence
  Description of Artificial Sequence: Synthetic peptide
GTWDSSLSAYV

SEQ ID NO: 840 - protein, 8 aa, Artificial Sequence
  Description of Artificial Sequence: Synthetic peptide
GFTFSSYA

SEQ ID NO: 841 - protein, 8 aa, Artificial Sequence
  Description of Artificial Sequence: Synthetic peptide
ISGGIGST

SEQ ID NO: 842 - protein, 14 aa, Artificial Sequence
  Description of Artificial Sequence: Synthetic peptide
AKDGVGATPYYFDY

SEQ ID NO: 843 - protein, 8 aa, Artificial Sequence
  Description of Artificial Sequence: Synthetic peptide
SSNIGINY

SEQ ID NO: 844 - protein, 3 aa, Artificial Sequence
  Description of Artificial Sequence: Synthetic peptide
DNN

SEQ ID NO: 845 - protein, 11 aa, Artificial Sequence
  Description of Artificial Sequence: Synthetic peptide
GTWDSSLSAVV

SEQ ID NO: 846 - protein, 8 aa, Artificial Sequence
  Description of Artificial Sequence: Synthetic peptide
GFTFSSYA

SEQ ID NO: 847 - protein, 8 aa, Artificial Sequence
  Description of Artificial Sequence: Synthetic peptide
ISGGSGST

SEQ ID NO: 848 - protein, 14 aa, Artificial Sequence
  Description of Artificial Sequence: Synthetic peptide
AKDGVGATPYYFDY

SEQ ID NO: 849 - protein, 8 aa, Artificial Sequence
  Description of Artificial Sequence: Synthetic peptide
SSNIGNNY

SEQ ID NO: 850 - protein, 3 aa, Artificial Sequence
  Description of Artificial Sequence: Synthetic peptide
DNN

SEQ ID NO: 851 - protein, 11 aa, Artificial Sequence
  Description of Artificial Sequence: Synthetic peptide
GTWDSSLSAYV

SEQ ID NO: 852 - protein, 8 aa, Artificial Sequence
  Description of Artificial Sequence: Synthetic peptide
GFTFSSYA

SEQ ID NO: 853 - protein, 8 aa, Artificial Sequence
  Description of Artificial Sequence: Synthetic peptide
ISGGSGST

SEQ ID NO: 854 - protein, 14 aa, Artificial Sequence
  Description of Artificial Sequence: Synthetic peptide
AKDGVGATPYYFDY

SEQ ID NO: 855 - protein, 8 aa, Artificial Sequence
  Description of Artificial Sequence: Synthetic peptide
SSNIGINY

SEQ ID NO: 856 - protein, 3 aa, Artificial Sequence
  Description of Artificial Sequence: Synthetic peptide
DNN

SEQ ID NO: 857 - protein, 11 aa, Artificial Sequence
  Description of Artificial Sequence: Synthetic peptide
GTWDSSLSAVV

SEQ ID NO: 858 - DNA, 363 bp, Artificial Sequence
  Description of Artificial Sequence: Synthetic polynucleotide
gaggtacaacttgtggaaagtggaggcggtcttgtccaacctggaggatctctccgattgagttgcgcagccagcgggtttactttttcttcatacgccatgtcctgggtgcggcaagcaccaggtaaaggacttgagtgggtatctgctatttcaggggggataggctcaacatactatgctgatagcgtgaaaggtaggttcaccatttcccgtgacaatagtaaaaacacattgtggctccaaatgaacagccttagggctgaagacaccgctgtttactactgcgctaaagacggtgtaggggcaactccctattacttcgattattggggacaaggaaccttggtaacagtttcaagc

SEQ ID NO: 859 - DNA, 330 bp, Artificial Sequence
  Description of Artificial Sequence: Synthetic polynucleotide
caatctgtcctgactcaacctccctcagtctcagccgcaccaggacagaaggtgacaattagctgttcaggttcttcaagtaacatcggtaacaactacgtctcatggtatcaacagcttcccggaacagcacccaaactgctgatatatgataacaacaaacggccatctggaataccagaccggttctcaggctccaagagcggtactagcgcaactttgggaatcaccggtttgcagactggggatgaggcagactattactgcggcacctgggattccagtctgtctgcttatgtttttgggaccgggacaaaggtgactgtcctt

SEQ ID NO: 860 - DNA, 363 bp, Artificial Sequence; identical to SEQ ID NO: 858
  Description of Artificial Sequence: Synthetic polynucleotide

SEQ ID NO: 861 - DNA, 330 bp, Artificial Sequence
  Description of Artificial Sequence: Synthetic polynucleotide
cagagtgtccttactcagcctcctagcgttagcgccgcccctggacagaaggttactatctcctgctcagggagttccagtaatattggaatcaattatgtgagttggtatcagcagttgcccggcaccgctcctaaattgcttatctatgacaacaataaacgacctagtggtatccctgatcgtttttctggatcaaaatctggtactagcgcaaccctcggtatcaccggactgcaaacaggtgatgaagcagactattattgcggcacctgggactcatcactctccgccgtcgttttcgggggcggaaccaaacttacagtattg

SEQ ID NO: 862 - DNA, 363 bp, Artificial Sequence
  Description of Artificial Sequence: Synthetic polynucleotide
gaagtccagttggtagaatctggaggcgggctggtacagcctggcggttccttgcgcctctcatgtgccgcaagcgggtttaccttcagctcttacgcaatgtcatgggtgcgtcaggcccctggaaaaggtctcgagtgggtcagtgccatttctgggggctccggctccacctactacgcagattcagttaaagggagatttacaatctcaagagataacagtaaaaacaccctctacctccagatgaactcacttcgagctgaggattcagcagtatattactgtgctaaagacggtgtaggtgcaactccctactatttcgactattggggccaagggactttggtgacagtaagtagt

SEQ ID NO: 863 - DNA, 330 bp, Artificial Sequence; identical to SEQ ID NO: 859
  Description of Artificial Sequence: Synthetic polynucleotide

SEQ ID NO: 864 - DNA, 363 bp, Artificial Sequence; identical to SEQ ID NO: 862
  Description of Artificial Sequence: Synthetic polynucleotide

SEQ ID NO: 865 - DNA, 330 bp, Artificial Sequence; identical to SEQ ID NO: 861
  Description of Artificial Sequence: Synthetic polynucleotide

SEQ ID NO: 866 - protein, 483 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGGSEGKSSGSGSESKSTGGSEVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDGVGATPYYFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 867 - protein, 483 aa, Artificial Sequence
  Description of Artificial Sequence: Synthetic polypeptide
QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVLGGSEGKSSGSGSESKSTGGSEVQLVESGGGLVQPGGSLRLSCAASGFTFSSYAMSWVRQAPGKGLEWVSAISGGIGSTYYADSVKGRFTISRDNSKNTLWLQMNSLRAEDTAVYYCAKDGVGATPYYFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 868 - protein, 483 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVLGGSEGKSSGSGSESKSTGGSEVQLVESGGGLVQPGGSLRLSCAASGFTFSSYAMSWVRQAPGKGLEWVSAISGGSGSTYYADSVKGRFTISRDNSKNTLYLQMNSLRAEDSAVYYCAKDGVGATPYYFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 869 - protein, 483 aa, Artificial Sequence
  Description of Artificial Sequence: Synthetic polypeptide
QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAVVFGGGTKLTVLGGSEGKSSGSGSESKSTGGSEVQLVESGGGLVQPGGSLRLSCAASGFTFSSYAMSWVRQAPGKGLEWVSAISGGSGSTYYADSVKGRFTISRDNSKNTLYLQMNSLRAEDSAVYYCAKDGVGATPYYFDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 870 - DNA, 1449 bp, Artificial Sequence
  Description of Artificial Sequence: Synthetic polynucleotide
cagtctgtgctgacccagcctccttctgtgtctgctgctcctggccagaaagtgaccatctcctgctccggctcctcctccaacatcggcaacaactacgtgtcctggtatcagcagctgcccggcacagctcccaaactgctgatctacgacaacaacaagcggcccagcggcatccctgacagattctccggatctaagtccggcacctctgctaccctgggcatcacaggattgcagacaggcgacgaggccgactactattgcggcacctgggactcttccctgtccgcttatgtgtttggcaccggcaccaaagtgaccgtgttgggcggctccgagggcaagagcagcggcagcggcagcgagagcaagagcaccggcggcagcgaggtgcagctggttgaatctggcggaggattggttcagcctggcggttctctgagactgtcttgtgccgcttccggcttcaccttctccagctacgctatgtcctgggtccgacaggctcctggcaaaggactggaatgggtgtccgctatctctggcggcatcggctctacctactacgccgactctgtgaagggcagattcaccatcagccgggacaactccaagaacaccctgtggctgcagatgaactccctgagagccgaggataccgccgtgtactactgtgccaaagatggcgtgggcgctaccccttactacttcgattattggggccagggcaccctggtcaccgtttcttctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 871 - DNA, 1449 bp, Artificial Sequence
  Description of Artificial Sequence: Synthetic polynucleotide
cagtctgtgctgacccagcctccttctgtgtctgctgctcctggccagaaagtgaccatctcctgctccggctcctcctccaacatcggcatcaactacgtgtcctggtatcagcagctgcccggcacagctcccaaactgctgatctacgacaacaacaagcggcccagcggcatccctgacagattctccggatctaagtccggcacctctgctaccctgggcatcacaggattgcagacaggcgacgaggccgactactattgcggcacctgggactcttctctgtccgccgttgtttttggcggtggcaccaagctgacagtgctcggcggctccgagggcaagagcagcggcagcggcagcgagagcaagagcaccggcggcagcgaggtgcagctggttgaatctggcggaggattggttcagcctggcggttctctgagactgtcttgtgccgcttccggcttcaccttctccagctacgctatgtcctgggtccgacaggctcctggcaaaggactggaatgggtgtccgctatctctggcggcatcggctctacctactacgccgactctgtgaagggcagattcaccatcagccgggacaactccaagaacaccctgtggctgcagatgaactccctgagagccgaggataccgccgtgtactactgtgccaaagatggcgtgggcgctaccccttactacttcgattattggggccagggcaccctggtcaccgtttcttctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 872 - DNA, 1449 bp, Artificial Sequence
  Description of Artificial Sequence: Synthetic polynucleotide
cagtctgtgctgacccagcctccttctgtgtctgctgctcctggccagaaagtgaccatctcctgctccggctcctcctccaacatcggcaacaactacgtgtcctggtatcagcagctgcccggcacagctcccaaactgctgatctacgacaacaacaagcggcccagcggcatccctgacagattctccggatctaagtccggcacctctgctaccctgggcatcacaggattgcagacaggcgacgaggccgactactattgcggcacctgggactcttccctgtccgcttatgtgtttggcaccggcaccaaagtgaccgtgttgggcggctccgagggcaagagcagcggcagcggcagcgagagcaagagcaccggcggcagcgaggtgcagctggttgaatctggcggaggattggttcagcctggcggttctctgagactgtcttgtgccgcttccggcttcaccttctccagctacgctatgtcctgggtccgacaggctcctggcaaaggactggaatgggtgtccgctatctctggcggatccggctctacctactacgccgactctgtgaagggcagattcaccatcagccgggacaactccaagaacaccctgtacctgcagatgaactccctgagagccgaggactccgccgtgtactactgtgctaaagatggcgtgggcgctaccccttactacttcgattattggggccagggcaccctggtcaccgtttcttctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 873 - DNA, 1449 bp, Artificial Sequence
  Description of Artificial Sequence: Synthetic polynucleotide
cagtctgtgctgacccagcctccttctgtgtctgctgctcctggccagaaagtgaccatctcctgctccggctcctcctccaacatcggcatcaactacgtgtcctggtatcagcagctgcccggcacagctcccaaactgctgatctacgacaacaacaagcggcccagcggcatccctgacagattctccggatctaagtccggcacctctgctaccctgggcatcacaggattgcagacaggcgacgaggccgactactattgcggcacctgggactcttctctgtccgccgttgtttttggtggaggcaccaagctgacagtgctcggcggctccgagggcaagagcagcggcagcggcagcgagagcaagagcaccggcggcagcgaggtgcagctggttgaatctggcggaggattggttcagcctggcggttctctgagactgtcttgtgccgcttccggcttcaccttctccagctacgctatgtcctgggtccgacaggctcctggcaaaggactggaatgggtgtccgctatctctggcggatccggctctacctactacgccgactctgtgaagggcagattcaccatcagccgggacaactccaagaacaccctgtacctgcagatgaactccctgagagccgaggactccgccgtgtactactgtgctaaagatggcgtgggcgctaccccttactacttcgattattggggccagggcaccctggtcaccgtttcttctgagcccaaatctagcgacaaaactcacacttgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacgtgctgcccccatcccgggaggagatgaccaagaaccaggtcagcctgctgtgcctggtcaaaggcttctatcccagcgacatcgccgtggagtgggagagcaatgggcagccggagaacaactacctcacctggcctcccgtgctggactccgacggctccttcttcctctacagcaagctcaccgtggacaagtccagatggcagcaggggaacgtcttctcatgctccgtgatgcatgaggctctgcacaaccactacacgcagaagtctctctccctgtctccgggaaaa

SEQ ID NO: 874 - protein, 240 aa, Artificial Sequence
  Description of Artificial Sequence: Synthetic polypeptide
VPLIEGRIVGGWECEKHSQPWQVAVYSHGWAHCGGVLVHPQWVLTAAHCLKKNSQVWLGRHNLFEPEDTGQRVPVSHSFPHPLYNMSLLKHQSLRPDEDSSHDLMLLRLSEPAKITDVVKVLGLPTQEPALGTTCYASGWGSIEPEEFLRPRSLQCVSLHYSEKVTEFMLCAGLWTGGKDTCGGDSGGPLVCNGVLQGITSWGPEPCALPEKPAVYTKVVHYRKWIKDTIAANPHHHHHH

SEQ ID NO: 875 - protein, 125 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSS

SEQ ID NO: 876 - protein, 107 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIK

SEQ ID NO: 877 - protein, 452 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 878 - protein, 214 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 879 - protein, 252 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSGGSEGKSSGSGSESKSTGGSDIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIK

SEQ ID NO: 880 - protein, 252 aa, Artificial Sequence
  Description of Artificial Sequence: Synthetic polypeptide
DIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKGGSEGKSSGSGSESKSTGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSS

SEQ ID NO: 881 - protein, 454 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 882 - protein, 455 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 883 - protein, 271 aa, Artificial Sequence
  Description of Artificial Sequence: Synthetic polypeptide
MAWVWTLLFLMAAAQSIQAQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSGGSEGKSSGSGSESKSTGGSDIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIK

SEQ ID NO: 884 - protein, 271 aa, Artificial Sequence
  Description of Artificial Sequence: Synthetic polypeptide
MAWVWTLLFLMAAAQSIQADIQMTQSPSFLSASVGDRVTITCRASQGISSYLAWYQQKPGKAPKFLIYAASTLQSGVPSRFSGSGSGTEFTLTISSLQPEDFATYYCQQLNSYPLTFGGGTKVEIKGGSEGKSSGSGSESKSTGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSS

SEQ ID NO: 885 - DNA, 1356 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattggatatatctattacagtgggagcaccaactacaacccctccctcaagagtcgagtcaccatatcagtagacacgtccaagaaccagttctccctgaagctgagctctgtgaccgctgcggacacggccgtgtattactgtgcggggactacgatttttggagtggttacccccaacttctactacggtatggacgtctggggccaagggaccacggtcaccgtctcctcagcttccaccaagggcccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaaaacctacacttgcaacgtagatcacaagcccagcaacaccaaggtggacaagagagttgagtccaaatatggtcccccatgcccaccatgcccagcacctgaggccgccgggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcagatggcaggaggggaatgtcttctcatgctccgtgatgcatgaggctctgcacaaccactacacacagaagagcctctccctgtctctgggtaaa

SEQ ID NO: 886 - DNA, 642 bp, Artificial Sequence
  Description of Artificial Sequence: Synthetic polynucleotide
gacatccagatgacccagtctccttccttcctgtctgcatctgtaggagacagagtcaccatcacttgccgggccagtcagggcattagcagttatttagcctggtatcagcaaaaaccagggaaagcccctaagttcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 887 - protein, 125 aa, Artificial Sequence; identical to SEQ ID NO: 875
  Description of Artificial Sequence: Synthetic polypeptide

SEQ ID NO: 888 - protein, 107 aa, Artificial Sequence; identical to SEQ ID NO: 876
  Description of Artificial Sequence: Synthetic polypeptide

SEQ ID NO: 889 - DNA, 375 bp, Artificial Sequence
  Description of Artificial Sequence: Synthetic polynucleotide
caggtgcagctgcaggagtcgggcccaggactggtgaagccttcggagaccctgtccctcacctgcactgtctctggtggctccatcagtagttactactggagctggatccggcagcccccagggaagggactggagtggattggatatatctattacagtgggagcaccaactacaacccctccctcaagagtcgagtcaccatatcagtagacacgtccaagaaccagttctccctgaagctgagctctgtgaccgctgcggacacggccgtgtattactgtgcggggactacgatttttggagtggttacccccaacttctactacggtatggacgtctggggccaagggaccacggtcaccgtctcctca

SEQ ID NO: 890 - DNA, 321 bp, Artificial Sequence
  Description of Artificial Sequence: Synthetic polynucleotide
gacatccagatgacccagtctccttccttcctgtctgcatctgtaggagacagagtcaccatcacttgccgggccagtcagggcattagcagttatttagcctggtatcagcaaaaaccagggaaagcccctaagttcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggaaatcaaa

SEQ ID NO: 891 - protein, 454 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPEDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYRQKSLSLSPG

SEQ ID NO: 892 - protein, 214 aa, Artificial Sequence; identical to SEQ ID NO: 878
  Description of Artificial Sequence: Synthetic polypeptide

SEQ ID NO: 893 - protein, 454 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 894 - protein, 454 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAGTTIFGVVTPNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 895 - DNA, 1362 bp, Artificial Sequence
  Description of Artificial Sequence: Synthetic polynucleotide
caagtacagcttcaggagtcaggccccggcttggtgaaaccaagtgagaccctctccctcacctgcacagttagcggcggttcaatatcatcatactattggtcttggattcgtcagccacctggcaaaggtctcgagtggattggctatatatattattcagggtcaacaaattacaatccttcactcaagtctcgcgtcaccattagcgtagacaccagcaaaaatcagttttccctcaagctctcatcagtgaccgccgcagataccgctgtatattactgcgctggtaccacaatatttggagtggttacccctaatttctattatggaatggacgtatggggccaggggaccaccgtgacagtttcctctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaactgctggggggaccgtcagtcttcctcttccccccaaaacccgaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactaccgccagaagagcctctccctgtctccgggt

SEQ ID NO: 896 - DNA, 642 bp, Artificial Sequence
  Description of Artificial Sequence: Synthetic polynucleotide
gatatacaaatgacccaatctccttcctttttgtcagcaagcgttggtgaccgcgtcaccataacttgtagggctagccagggtatttctagttatctggcttggtatcagcaaaaacctggcaaagcccctaaatttcttatctacgccgcaagcactctgcaatcaggcgtgcccagcagattctcaggctctggttcaggcacagagtttactctgactatatccagcctgcaacctgaagactttgctacatactattgtcagcaactcaacagttacccccttactttcgggggcggcactaaggtggaaataaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 897 - DNA, 1362 bp, Artificial Sequence
  Description of Artificial Sequence: Synthetic polynucleotide
caagtacagcttcaggagtcaggccccggcttggtgaaaccaagtgagaccctctccctcacctgcacagttagcggcggttcaatatcatcatactattggtcttggattcgtcagccacctggcaaaggtctcgagtggattggctatatatattattcagggtcaacaaattacaatccttcactcaagtctcgcgtcaccattagcgtagacaccagcaaaaatcagttttccctcaagctctcatcagtgaccgccgcagataccgctgtatattactgcgctggtaccacaatatttggagtggttacccctaatttctattatggaatggacgtatggggccaggggaccaccgtgacagtttcctctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaagcagcagggggaccgtcagtcttcctcttccccccaaaacccaaggacaccctcatgatctcccggacccctgaggtcacatgcgtggtggtgagcgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 898 - DNA, 1362 bp, Artificial Sequence
  Description of Artificial Sequence: Synthetic polynucleotide
caagtacagcttcaggagtcaggccccggcttggtgaaaccaagtgagaccctctccctcacctgcacagttagcggcggttcaatatcatcatactattggtcttggattcgtcagccacctggcaaaggtctcgagtggattggctatatatattattcagggtcaacaaattacaatccttcactcaagtctcgcgtcaccattagcgtagacaccagcaaaaatcagttttccctcaagctctcatcagtgaccgccgcagataccgctgtatattactgcgctggtaccacaatatttggagtggttacccctaatttctattatggaatggacgtatggggccaggggaccaccgtgacagtttcctctgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgtccaccgtgcccagcacctgaactgctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagtctagatggcagcaggggaacgtcttctcatgctccgtgatgcatgaggctctgcacaaccactacacgcagaagagcctctccctgtctccgggt

SEQ ID NO: 899 - protein, 125 aa, Artificial Sequence
  Description of Artificial Sequence: Synthetic polypeptide
QLQLQESGPGLVKPSETLSLTCTVSGASISSPSYYWGWIRQPPGKGLEWIGSIFYSGSSYYNPSLKSRVIMSVDTSKNQFSLKLSSVTAADTALYYCASQSGVSGWYGAEYFQHWGQGTLVTVSS

SEQ ID NO: 900 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSRTFGQGTKVEIK

SEQ ID NO: 901 - protein, 7 aa, Artificial Sequence
  Description of Artificial Sequence: Synthetic peptide
SPSYYWG

SEQ ID NO: 902 - protein, 16 aa, Artificial Sequence
  Description of Artificial Sequence: Synthetic peptide
SIFYSGSSYYNPSLKS

SEQ ID NO: 903 - protein, 15 aa, Artificial Sequence
  Description of Artificial Sequence: Synthetic peptide
QSGVSGWYGAEYFQH

SEQ ID NO: 904 - protein, 11 aa, Artificial Sequence
  Description of Artificial Sequence: Synthetic peptide
RASQSISSWLA

SEQ ID NO: 905 - protein, 7 aa, Artificial Sequence
  Description of Artificial Sequence: Synthetic peptide
KASSLES

SEQ ID NO: 906 - protein, 9 aa, Artificial Sequence
  Description of Artificial Sequence: Synthetic peptide
QQYNSYSRT

SEQ ID NO: 907 - protein, 9 aa, Artificial Sequence
  Description of Artificial Sequence: Synthetic peptide
GASISSPSY

SEQ ID NO: 908 - protein, 5 aa, Artificial Sequence
  Description of Artificial Sequence: Synthetic peptide
FYSGS

SEQ ID NO: 909 - protein, 15 aa, Artificial Sequence
  Description of Artificial Sequence: Synthetic peptide
QSGVSGWYGAEYFQH

SEQ ID NO: 910 - protein, 11 aa, Artificial Sequence
  Description of Artificial Sequence: Synthetic peptide
RASQSISSWLA

SEQ ID NO: 911 - protein, 7 aa, Artificial Sequence
  Description of Artificial Sequence: Synthetic peptide
KASSLES

SEQ ID NO: 912 - protein, 9 aa, Artificial Sequence
  Description of Artificial Sequence: Synthetic peptide
QQYNSYSRT

SEQ ID NO: 913 - protein, 12 aa, Artificial Sequence
  Description of Artificial Sequence: Synthetic peptide
GASISSPSYYWG

SEQ ID NO: 914 - protein, 9 aa, Artificial Sequence
  Description of Artificial Sequence: Synthetic peptide
SIFYSGSSY

SEQ ID NO: 915 - protein, 15 aa, Artificial Sequence
  Description of Artificial Sequence: Synthetic peptide
QSGVSGWYGAEYFQH

SEQ ID NO: 916 - protein, 11 aa, Artificial Sequence
  Description of Artificial Sequence: Synthetic peptide
RASQSISSWLA

SEQ ID NO: 917 - protein, 7 aa, Artificial Sequence
  Description of Artificial Sequence: Synthetic peptide
KASSLES

SEQ ID NO: 918 - protein, 9 aa, Artificial Sequence
  Description of Artificial Sequence: Synthetic peptide
QQYNSYSRT

SEQ ID NO: 919 - protein, 8 aa, Artificial Sequence
  Description of Artificial Sequence: Synthetic peptide
SSPSYYWG

SEQ ID NO: 920 - protein, 12 aa, Artificial Sequence
  Description of Artificial Sequence: Synthetic peptide
WIGSIFYSGSSY

SEQ ID NO: 921 - protein, 16 aa, Artificial Sequence
  Description of Artificial Sequence: Synthetic peptide
ASQSGVSGWYGAEYFQ

SEQ ID NO: 922 - protein, 7 aa, Artificial Sequence
  Description of Artificial Sequence: Synthetic peptide
SSWLAWY

SEQ ID NO: 923 - protein, 10 aa, Artificial Sequence
  Description of Artificial Sequence: Synthetic peptide
LLIYKASSLE

SEQ ID NO: 924 - protein, 8 aa, Artificial Sequence
  Description of Artificial Sequence: Synthetic peptide
QQYNSYSR

SEQ ID NO: 925 - protein, 10 aa, Artificial Sequence
  Description of Artificial Sequence: Synthetic peptide
GASISSPSYY

SEQ ID NO: 926 - protein, 7 aa, Artificial Sequence
  Description of Artificial Sequence: Synthetic peptide
IFYSGSS

SEQ ID NO: 927 - protein, 17 aa, Artificial Sequence
  Description of Artificial Sequence: Synthetic peptide
ASQSGVSGWYGAEYFQH

SEQ ID NO: 928 - protein, 6 aa, Artificial Sequence
  Description of Artificial Sequence: Synthetic peptide
QSISSW

SEQ ID NO: 929 - protein, 3 aa, Artificial Sequence
  Description of Artificial Sequence: Synthetic peptide
KAS

SEQ ID NO: 930 - protein, 9 aa, Artificial Sequence
  Description of Artificial Sequence: Synthetic peptide
QQYNSYSRT

SEQ ID NO: 931 - protein, 484 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYNSYSRTFGQGTKVEIKGGSEGKSSGSGSESKSTGGSQLQLQESGPGLVKPSETLSLTCTVSGASISSPSYYWGWIRQPPGKGLEWIGSIFYSGSSYYNPSLKSRVIMSVDTSKNQFSLKLSSVTAADTALYYCASQSGVSGWYGAEYFQHWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 932 - protein, 450 aa, Artificial Sequence
  Description of Artificial Sequence: Synthetic polypeptide
QVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 933 - protein, 219 aa, Artificial Sequence; identical to SEQ ID NO: 723
  Description of Artificial Sequence: Synthetic polypeptide

SEQ ID NO: 934 - protein, 450 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 935 - protein, 218 aa, Artificial Sequence; identical to SEQ ID NO: 18
  Description of Artificial Sequence: Synthetic polypeptide

SEQ ID NO: 936 - protein, 7 aa, Artificial Sequence
  Description of Artificial Sequence: Synthetic peptide
TSGMGVS

SEQ ID NO: 937 - protein, 16 aa, Artificial Sequence
  Description of Artificial Sequence: Synthetic peptide
HIYWDDDKRYNPSLKS

SEQ ID NO: 938 - protein, 10 aa, Artificial Sequence
  Description of Artificial Sequence: Synthetic peptide
LYGFTYGFAY

SEQ ID NO: 939 - protein, 15 aa, Artificial Sequence
  Description of Artificial Sequence: Synthetic peptide
RASQSVDYNGISYMH

SEQ ID NO: 940 - protein, 7 aa, Artificial Sequence
  Description of Artificial Sequence: Synthetic peptide
AASNPES

SEQ ID NO: 941 - protein, 9 aa, Artificial Sequence
  Description of Artificial Sequence: Synthetic peptide
QQIIEDPWT

SEQ ID NO: 942 - protein, 12 aa, Artificial Sequence
  Description of Artificial Sequence: Synthetic peptide
GFSLSTSGMGVS

SEQ ID NO: 943 - protein, 9 aa, Artificial Sequence
  Description of Artificial Sequence: Synthetic peptide
HIYWDDDKR

SEQ ID NO: 944 - protein, 10 aa, Artificial Sequence
  Description of Artificial Sequence: Synthetic peptide
LYGFTYGFAY

SEQ ID NO: 945 - protein, 9 aa, Artificial Sequence
  Description of Artificial Sequence: Synthetic peptide
GFSLSTSGM

SEQ ID NO: 946 - protein, 5 aa, Artificial Sequence
  Description of Artificial Sequence: Synthetic peptide
YWDDD

SEQ ID NO: 947 - protein, 10 aa, Artificial Sequence
  Description of Artificial Sequence: Synthetic peptide
LYGFTYGFAY

SEQ ID NO: 948 - protein, 10 aa, Artificial Sequence
  Description of Artificial Sequence: Synthetic peptide
GFSLSTSGMG

SEQ ID NO: 949 - protein, 7 aa, Artificial Sequence
  Description of Artificial Sequence: Synthetic peptide
IYWDDDK

SEQ ID NO: 950 - protein, 12 aa, Artificial Sequence
  Description of Artificial Sequence: Synthetic peptide
ARLYGFTYGFAY

SEQ ID NO: 951 - protein, 8 aa, Artificial Sequence
  Description of Artificial Sequence: Synthetic peptide
STSGMGVS

SEQ ID NO: 952 - protein, 12 aa, Artificial Sequence
  Description of Artificial Sequence: Synthetic peptide
WLAHIYWDDDKR

SEQ ID NO: 953 - protein, 11 aa, Artificial Sequence
  Description of Artificial Sequence: Synthetic peptide
ARLYGFTYGFA

SEQ ID NO: 954 - protein, 15 aa, Artificial Sequence
  Description of Artificial Sequence: Synthetic peptide
RASQSVDYNGISYMH

SEQ ID NO: 955 - protein, 7 aa, Artificial Sequence
  Description of Artificial Sequence: Synthetic peptide
AASNPES

SEQ ID NO: 956 - protein, 9 aa, Artificial Sequence
  Description of Artificial Sequence: Synthetic peptide
QQIIEDPWT

SEQ ID NO: 957 - protein, 15 aa, Artificial Sequence
  Description of Artificial Sequence: Synthetic peptide
RASQSVDYNGISYMH

SEQ ID NO: 958 - protein, 7 aa, Artificial Sequence
  Description of Artificial Sequence: Synthetic peptide
AASNPES

SEQ ID NO: 959 - protein, 9 aa, Artificial Sequence
  Description of Artificial Sequence: Synthetic peptide
QQIIEDPWT

SEQ ID NO: 960 - protein, 10 aa, Artificial Sequence
  Description of Artificial Sequence: Synthetic peptide
QSVDYNGISY

SEQ ID NO: 961 - protein, 3 aa, Artificial Sequence
  Description of Artificial Sequence: Synthetic peptide
AAS

SEQ ID NO: 962 - protein, 9 aa, Artificial Sequence
  Description of Artificial Sequence: Synthetic peptide
QQIIEDPWT

SEQ ID NO: 963 - protein, 11 aa, Artificial Sequence
  Description of Artificial Sequence: Synthetic peptide
DYNGISYMHWY

SEQ ID NO: 964 - protein, 10 aa, Artificial Sequence
  Description of Artificial Sequence: Synthetic peptide
LLIYAASNPE

SEQ ID NO: 965 - protein, 8 aa, Artificial Sequence
  Description of Artificial Sequence: Synthetic peptide
QQIIEDPW

SEQ ID NO: 966 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSS

SEQ ID NO: 967 - protein, 111 aa, Artificial Sequence
  Description of Artificial Sequence: Synthetic polypeptide
DIVMTQSPDSLAVSLGERATINCRASQSVDYNGISYMHWYQQKPGQPPKLLIYAASNPESGVPDRFSGSGSGTDFTLTISSLQAEDVAVYYCQQIIEDPWTFGQGTKVEIK

SEQ ID NO: 968 - protein, 5 aa, Artificial Sequence
  Description of Artificial Sequence: Synthetic peptide
DVQLW

SEQ ID NO: 969 - DNA, 2154 bp, Artificial Sequence; identical to SEQ ID NO: 33
  Description of Artificial Sequence: Synthetic polynucleotide

SEQ ID NO: 970 - protein, 11 aa, Artificial Sequence
  B17B860_G34Q HC AbM CDR1
GYSITSGYFWN

SEQ ID NO: 971 - protein, 9 aa, Artificial Sequence
  B17B860_G34Q HC AbM CDR2
YISYDGSNN

SEQ ID NO: 972 - protein, 11 aa, Artificial Sequence
  B17B860_G34Q HC AbM CDR3
PSPGTGYAVDY

SEQ ID NO: 973 - protein, 6 aa, Artificial Sequence
  B17B860_G34Q HC KABAT CDR1
SGYFWN

SEQ ID NO: 974 - protein, 16 aa, Artificial Sequence
  B17B860_G34Q HC KABAT CDR2
YISYDGSNNYNPSLKS

SEQ ID NO: 975 - protein, 11 aa, Artificial Sequence
  B17B860_G34Q HC KABAT CDR3
PSPGTGYAVDY

SEQ ID NO: 976 - protein, 8 aa, Artificial Sequence
  B17B860_G34Q HC CHOTHIA CDR1
GYSITSGY

SEQ ID NO: 977 - protein, 5 aa, Artificial Sequence
  B17B860_G34Q HC CHOTHIA CDR2
SYDGS

SEQ ID NO: 978 - protein, 11 aa, Artificial Sequence
  B17B860_G34Q HC CHOTHIA CDR3
PSPGTGYAVDY

SEQ ID NO: 979 - protein, 9 aa, Artificial Sequence
  B17B860_G34Q HC IMGT CDR1
GYSITSGYF

SEQ ID NO: 980 - protein, 7 aa, Artificial Sequence
  B17B860_G34Q HC IMGT CDR2
ISYDGSN

SEQ ID NO: 981 - protein, 13 aa, Artificial Sequence
  B17B860_G34Q HC IMGT CDR3
ASPSPGTGYAVDY

SEQ ID NO: 982 - protein, 7 aa, Artificial Sequence
  B17B860_G34Q HC CONTACT CDR1
TSGYFWN

SEQ ID NO: 983 - protein, 12 aa, Artificial Sequence
  B17B860_G34Q HC CONTACT CDR2
WIGYISYDGSNN

SEQ ID NO: 984 - protein, 12 aa, Artificial Sequence
  B17B860_G34Q HC CONTACT CDR3
ASPSPGTGYAVD

SEQ ID NO: 985 - protein, 16 aa, Artificial Sequence
  B17B860_G34Q LC AbM CDR1
RSSQSLVHSNQNTYLH

SEQ ID NO: 986 - protein, 7 aa, Artificial Sequence
  B17B860_G34Q LC AbM CDR2
KVSNRFS

SEQ ID NO: 987 - protein, 9 aa, Artificial Sequence
  B17B860_G34Q LC AbM CDR3
SQSTHVPFT

SEQ ID NO: 988 - protein, 16 aa, Artificial Sequence
  B17B860_G34Q LC KABAT CDR1
RSSQSLVHSNQNTYLH

SEQ ID NO: 989 - protein, 7 aa, Artificial Sequence
  B17B860_G34Q LC KABAT CDR2
KVSNRFS

SEQ ID NO: 990 - protein, 9 aa, Artificial Sequence
  B17B860_G34Q LC KABAT CDR3
SQSTHVPFT

SEQ ID NO: 991 - protein, 16 aa, Artificial Sequence
  B17B860_G34Q LC CHOTHIA CDR1
RSSQSLVHSNQNTYLH

SEQ ID NO: 992 - protein, 7 aa, Artificial Sequence
  B17B860_G34Q LC CHOTHIA CDR2
KVSNRFS

SEQ ID NO: 993 - protein, 9 aa, Artificial Sequence
  B17B860_G34Q LC CHOTHIA CDR3
SQSTHVPFT

SEQ ID NO: 994 - protein, 11 aa, Artificial Sequence
  B17B860_G34Q LC IMGT CDR1
QSLVHSNQNTY

SEQ ID NO: 995 - protein, 3 aa, Artificial Sequence
  B17B860_G34Q LC IMGT CDR2
KVS

SEQ ID NO: 996 - protein, 9 aa, Artificial Sequence
  B17B860_G34Q LC IMGT CDR3
SQSTHVPFT

SEQ ID NO: 997 - protein, 12 aa, Artificial Sequence
  B17B860_G34Q LC CONTACT CDR1
VHSNQNTYLHWY

SEQ ID NO: 998 - protein, 10 aa, Artificial Sequence
  B17B860_G34Q LC CONTACT CDR2
LLIYKVSNRF

SEQ ID NO: 999 - protein, 8 aa, Artificial Sequence
  B17B860_G34Q LC CONTACT CDR3
SQSTHVPF

SEQ ID NO: 1000 - protein, 120 aa, Artificial Sequence
  B17B860_G34Q HC AA
QVQLQESGPGLVKPSETLSLTCTVSGYSITSGYFWNWIRQFPGKGLEWIGYISYDGSNNYNPSLKSRVTISRDTSKNQFSLKLSSVTAADTAVYYCASPSPGTGYAVDYWGQGTTVTVSS

SEQ ID NO: 1001 - protein, 112 aa, Artificial Sequence
  B17B860_G34Q LC AA
DIQMTQSPSSLSASVGDRVTITCRSSQSLVHSNQNTYLHWYQQKPGKAPKLLIYKVSNRFSGVPSRFSGSGSGTDFTLTISSLQPEDFATYYCSQSTHVPFTFGQGTKLEIK

SEQ ID NO: 1002 - protein, 11 aa, Artificial Sequence
  B17B852_G34R HC AbM CDR1
GYSITSGYFWN

SEQ ID NO: 1003 - protein, 9 aa, Artificial Sequence
  B17B852_G34R HC AbM CDR2
YISYDGSNN

SEQ ID NO: 1004 - protein, 11 aa, Artificial Sequence
  B17B852_G34R HC AbM CDR3
PSPGTGYAVDY

SEQ ID NO: 1005 - protein, 6 aa, Artificial Sequence
  B17B852_G34R HC KABAT CDR1
SGYFWN

SEQ ID NO: 1006 - protein, 16 aa, Artificial Sequence
  B17B852_G34R HC KABAT CDR2
YISYDGSNNYNPSLKS

SEQ ID NO: 1007 - protein, 11 aa, Artificial Sequence
  B17B852_G34R HC KABAT CDR3
PSPGTGYAVDY

SEQ ID NO: 1008 - protein, 8 aa, Artificial Sequence
  B17B852_G34R HC CHOTHIA CDR1
GYSITSGY

SEQ ID NO: 1009 - protein, 5 aa, Artificial Sequence
  B17B852_G34R HC CHOTHIA CDR2
SYDGS

SEQ ID NO: 1010 - protein, 11 aa, Artificial Sequence
  B17B852_G34R HC CHOTHIA CDR3
PSPGTGYAVDY

SEQ ID NO: 1011 - protein, 9 aa, Artificial Sequence
  B17B852_G34R HC IMGT CDR1
GYSITSGYF

SEQ ID NO: 1012 - protein, 7 aa, Artificial Sequence
  B17B852_G34R HC IMGT CDR2
ISYDGSN

SEQ ID NO: 1013 - protein, 13 aa, Artificial Sequence
  B17B852_G34R HC IMGT CDR3
ASPSPGTGYAVDY

SEQ ID NO: 1014 - protein, 7 aa, Artificial Sequence
  B17B852_G34R HC CONTACT CDR1
TSGYFWN

SEQ ID NO: 1015 - protein, 12 aa, Artificial Sequence
  B17B852_G34R HC CONTACT CDR2
WMGYISYDGSNN

SEQ ID NO: 1016 - protein, 12 aa, Artificial Sequence
  B17B852_G34R HC CONTACT CDR3
ASPSPGTGYAVD

SEQ ID NO: 1017 - protein, 16 aa, Artificial Sequence
  B17B852_G34R LC AbM CDR1
RSSQSLVHSNRNTYLH

SEQ ID NO: 1018 - protein, 7 aa, Artificial Sequence
  B17B852_G34R LC AbM CDR2
KVSNRFS

SEQ ID NO: 1019 - protein, 9 aa, Artificial Sequence
  B17B852_G34R LC AbM CDR3
SQSTHVPFT

SEQ ID NO: 1020 - protein, 16 aa, Artificial Sequence
  B17B852_G34R LC KABAT CDR1
RSSQSLVHSNRNTYLH

SEQ ID NO: 1021 - protein, 7 aa, Artificial Sequence
  B17B852_G34R LC KABAT CDR2
KVSNRFS

SEQ ID NO: 1022 - protein, 9 aa, Artificial Sequence
  B17B852_G34R LC KABAT CDR3
SQSTHVPFT

SEQ ID NO: 1023 - protein, 16 aa, Artificial Sequence
  B17B852_G34R LC CHOTHIA CDR1
RSSQSLVHSNRNTYLH

SEQ ID NO: 1024 - protein, 7 aa, Artificial Sequence
  B17B852_G34R LC CHOTHIA CDR2
KVSNRFS

SEQ ID NO: 1025 - protein, 9 aa, Artificial Sequence
  B17B852_G34R LC CHOTHIA CDR3
SQSTHVPFT

SEQ ID NO: 1026 - protein, 11 aa, Artificial Sequence
  B17B852_G34R LC IMGT CDR1
QSLVHSNRNTY

SEQ ID NO: 1027 - protein, 3 aa, Artificial Sequence
  B17B852_G34R LC IMGT CDR2
KVS

SEQ ID NO: 1028 - protein, 9 aa, Artificial Sequence
  B17B852_G34R LC IMGT CDR3
SQSTHVPFT

SEQ ID NO: 1029 - protein, 12 aa, Artificial Sequence
  B17B852_G34R LC CONTACT CDR1
VHSNRNTYLHWY

SEQ ID NO: 1030 - protein, 10 aa, Artificial Sequence
  B17B852_G34R LC CONTACT CDR2
LLIYKVSNRF

SEQ ID NO: 1031 - protein, 8 aa, Artificial Sequence
  B17B852_G34R LC CONTACT CDR3
SQSTHVPF

SEQ ID NO: 1032 - protein, 120 aa, Artificial Sequence
  B17B852_G34R HC AA
QVQLQESGPGLVKPSETLSLTCTVSGYSITSGYFWNWIRQFPGKGLEWMGYISYDGSNNYNPSLKSRITISRDTSKNQFSLKLSSVTAADTAVYYCASPSPGTGYAVDYWGQGTTVTVSS

SEQ ID NO: 1033 - protein, 112 aa, Artificial Sequence
  B17B852_G34R LC AA
DIQMTQSPSSLSASVGDRVTITCRSSQSLVHSNRNTYLHWYQQKPGKAPKLLIYKVSNRFSGVPSRFSGSGSGTDFTLTISSLQPEDFATYYCSQSTHVPFTFGQGTKLEIK

SEQ ID NO: 1034 - protein, 11 aa, Artificial Sequence
  B17B860_G34K HC AbM CDR1
GYSITSGYFWN

SEQ ID NO: 1035 - protein, 9 aa, Artificial Sequence
  B17B860_G34K HC AbM CDR2
YISYDGSNN

SEQ ID NO: 1036 - protein, 11 aa, Artificial Sequence
  B17B860_G34K HC AbM CDR3
PSPGTGYAVDY

SEQ ID NO: 1037 - protein, 6 aa, Artificial Sequence
  B17B860_G34K HC KABAT CDR1
SGYFWN

SEQ ID NO: 1038 - protein, 16 aa, Artificial Sequence
  B17B860_G34K HC KABAT CDR2
YISYDGSNNYNPSLKS

SEQ ID NO: 1039 - protein, 11 aa, Artificial Sequence
  B17B860_G34K HC KABAT CDR3
PSPGTGYAVDY

SEQ ID NO: 1040 - protein, 8 aa, Artificial Sequence
  B17B860_G34K HC CHOTHIA CDR1
GYSITSGY

SEQ ID NO: 1041 - protein, 5 aa, Artificial Sequence
  B17B860_G34K HC CHOTHIA CDR2
SYDGS

SEQ ID NO: 1042 - protein, 11 aa, Artificial Sequence
  B17B860_G34K HC CHOTHIA CDR3
PSPGTGYAVDY

SEQ ID NO: 1043 - protein, 9 aa, Artificial Sequence
  B17B860_G34K HC IMGT CDR1
GYSITSGYF

SEQ ID NO: 1044 - protein, 7 aa, Artificial Sequence
  B17B860_G34K HC IMGT CDR2
ISYDGSN

SEQ ID NO: 1045 - protein, 13 aa, Artificial Sequence
  B17B860_G34K HC IMGT CDR3
ASPSPGTGYAVDY

SEQ ID NO: 1046 - protein, 7 aa, Artificial Sequence
  B17B860_G34K HC CONTACT CDR1
TSGYFWN

SEQ ID NO: 1047 - protein, 12 aa, Artificial Sequence
  B17B860_G34K HC CONTACT CDR2
WIGYISYDGSNN

SEQ ID NO: 1048 - protein, 12 aa, Artificial Sequence
  B17B860_G34K HC CONTACT CDR3
ASPSPGTGYAVD

SEQ ID NO: 1049 - protein, 16 aa, Artificial Sequence
  B17B860_G34K LC AbM CDR1
RSSQSLVHSNKNTYLH

SEQ ID NO: 1050 - protein, 7 aa, Artificial Sequence
  B17B860_G34K LC AbM CDR2
KVSNRFS

SEQ ID NO: 1051 - protein, 9 aa, Artificial Sequence
  B17B860_G34K LC AbM CDR3
SQSTHVPFT

SEQ ID NO: 1052 - protein, 16 aa, Artificial Sequence
  B17B860_G34K LC KABAT CDR1
RSSQSLVHSNKNTYLH

SEQ ID NO: 1053 - protein, 7 aa, Artificial Sequence
  B17B860_G34K LC KABAT CDR2
KVSNRFS

SEQ ID NO: 1054 - protein, 9 aa, Artificial Sequence
  B17B860_G34K LC KABAT CDR3
SQSTHVPFT

SEQ ID NO: 1055 - protein, 16 aa, Artificial Sequence
  B17B860_G34K LC CHOTHIA CDR1
RSSQSLVHSNKNTYLH

SEQ ID NO: 1056 - protein, 7 aa, Artificial Sequence
  B17B860_G34K LC CHOTHIA CDR2
KVSNRFS

SEQ ID NO: 1057 - protein, 9 aa, Artificial Sequence
  B17B860_G34K LC CHOTHIA CDR3
SQSTHVPFT

SEQ ID NO: 1058 - protein, 11 aa, Artificial Sequence
  B17B860_G34K LC IMGT CDR1
QSLVHSNKNTY

SEQ ID NO: 1059 - protein, 3 aa, Artificial Sequence
  B17B860_G34K LC IMGT CDR2
KVS

SEQ ID NO: 1060 - protein, 9 aa, Artificial Sequence
  B17B860_G34K LC IMGT CDR3
SQSTHVPFT

SEQ ID NO: 1061 - protein, 12 aa, Artificial Sequence
  B17B860_G34K LC CONTACT CDR1
VHSNKNTYLHWY

SEQ ID NO: 1062 - protein, 10 aa, Artificial Sequence
  B17B860_G34K LC CONTACT CDR2
LLIYKVSNRF

SEQ ID NO: 1063 - protein, 8 aa, Artificial Sequence
  B17B860_G34K LC CONTACT CDR3
SQSTHVPF

SEQ ID NO: 1064 - protein, 120 aa, Artificial Sequence; identical to SEQ ID NO: 1000
  B17B860_G34K HC AA

SEQ ID NO: 1065 - protein, 112 aa, Artificial Sequence
  B17B860_G34K LC AA
DIQMTQSPSSLSASVGDRVTITCRSSQSLVHSNKNTYLHWYQQKPGKAPKLLIYKVSNRFSGVPSRFSGSGSGTDFTLTISSLQPEDFATYYCSQSTHVPFTFGQGTKLEIK

SEQ ID NO: 1066 - protein, 11 aa, Artificial Sequence
  B17B852_N33T HC AbM CDR1
GYSITSGYFWN

SEQ ID NO: 1067 - protein, 9 aa, Artificial Sequence
  B17B852_N33T HC AbM CDR2
YISYDGSNN

SEQ ID NO: 1068 - protein, 11 aa, Artificial Sequence
  B17B852_N33T HC AbM CDR3
PSPGTGYAVDY

SEQ ID NO: 1069 - protein, 6 aa, Artificial Sequence
  B17B852_N33T HC KABAT CDR1
SGYFWN

SEQ ID NO: 1070 - protein, 16 aa, Artificial Sequence
  B17B852_N33T HC KABAT CDR2
YISYDGSNNYNPSLKS

SEQ ID NO: 1071 - protein, 11 aa, Artificial Sequence
  B17B852_N33T HC KABAT CDR3
PSPGTGYAVDY

SEQ ID NO: 1072 - protein, 8 aa, Artificial Sequence
  B17B852_N33T HC CHOTHIA CDR1
GYSITSGY

SEQ ID NO: 1073 - protein, 5 aa, Artificial Sequence
  B17B852_N33T HC CHOTHIA CDR2
SYDGS

SEQ ID NO: 1074 - protein, 11 aa, Artificial Sequence
  B17B852_N33T HC CHOTHIA CDR3
PSPGTGYAVDY

SEQ ID NO: 1075 - protein, 9 aa, Artificial Sequence
  B17B852_N33T HC IMGT CDR1
GYSITSGYF

SEQ ID NO: 1076 - protein, 7 aa, Artificial Sequence
  B17B852_N33T HC IMGT CDR2
ISYDGSN

SEQ ID NO: 1077 - protein, 13 aa, Artificial Sequence
  B17B852_N33T HC IMGT CDR3
ASPSPGTGYAVDY

SEQ ID NO: 1078 - protein, 7 aa, Artificial Sequence
  B17B852_N33T HC CONTACT CDR1
TSGYFWN

SEQ ID NO: 1079 - protein, 12 aa, Artificial Sequence
  B17B852_N33T HC CONTACT CDR2
WMGYISYDGSNN

SEQ ID NO: 1080 - protein, 12 aa, Artificial Sequence
  B17B852_N33T HC CONTACT CDR3
ASPSPGTGYAVD

SEQ ID NO: 1081 - protein, 16 aa, Artificial Sequence
  B17B852_N33T LC AbM CDR1
RSSQSLVHSTGNTYLH

SEQ ID NO: 1082 - protein, 7 aa, Artificial Sequence
  B17B852_N33T LC AbM CDR2
KVSNRFS

SEQ ID NO: 1083 - protein, 9 aa, Artificial Sequence
  B17B852_N33T LC AbM CDR3
SQSTHVPFT

SEQ ID NO: 1084 - protein, 16 aa, Artificial Sequence
  B17B852_N33T LC KABAT CDR1
RSSQSLVHSTGNTYLH

SEQ ID NO: 1085 - protein, 7 aa, Artificial Sequence
  B17B852_N33T LC KABAT CDR2
KVSNRFS

SEQ ID NO: 1086 - protein, 9 aa, Artificial Sequence
  B17B852_N33T LC KABAT CDR3
SQSTHVPFT

SEQ ID NO: 1087 - protein, 16 aa, Artificial Sequence
  B17B852_N33T LC CHOTHIA CDR1
RSSQSLVHSTGNTYLH

SEQ ID NO: 1088 - protein, 7 aa, Artificial Sequence
  B17B852_N33T LC CHOTHIA CDR2
KVSNRFS

SEQ ID NO: 1089 - protein, 9 aa, Artificial Sequence
  B17B852_N33T LC CHOTHIA CDR3
SQSTHVPFT

SEQ ID NO: 1090 - protein, 11 aa, Artificial Sequence
  B17B852_N33T LC IMGT CDR1
QSLVHSTGNTY

SEQ ID NO: 1091 - protein, 3 aa, Artificial Sequence
  B17B852_N33T LC IMGT CDR2
KVS

SEQ ID NO: 1092 - protein, 9 aa, Artificial Sequence
  B17B852_N33T LC IMGT CDR3
SQSTHVPFT

SEQ ID NO: 1093 - protein, 12 aa, Artificial Sequence
  B17B852_N33T LC CONTACT CDR1
VHSTGNTYLHWY

SEQ ID NO: 1094 - protein, 10 aa, Artificial Sequence
  B17B852_N33T LC CONTACT CDR2
LLIYKVSNRF

SEQ ID NO: 1095 - protein, 8 aa, Artificial Sequence
  B17B852_N33T LC CONTACT CDR3
SQSTHVPF

SEQ ID NO: 1096 - protein, 120 aa, Artificial Sequence; identical to SEQ ID NO: 1032
  B17B852_N33T HC AA

SEQ ID NO: 1097 - protein, 112 aa, Artificial Sequence
  B17B852_N33T LC AA
DIQMTQSPSSLSASVGDRVTITCRSSQSLVHSTGNTYLHWYQQKPGKAPKLLIYKVSNRFSGVPSRFSGSGSGTDFTLTISSLQPEDFATYYCSQSTHVPFTFGQGTKLEIK

SEQ ID NO: 1098 - protein, 11 aa, Artificial Sequence
  B17B852_G34K HC AbM CDR1
GYSITSGYFWN

SEQ ID NO: 1099 - protein, 9 aa, Artificial Sequence
  B17B852_G34K HC AbM CDR2
YISYDGSNN

SEQ ID NO: 1100 - protein, 11 aa, Artificial Sequence
  B17B852_G34K HC AbM CDR3
PSPGTGYAVDY

SEQ ID NO: 1101 - protein, 6 aa, Artificial Sequence
  B17B852_G34K HC KABAT CDR1
SGYFWN

SEQ ID NO: 1102 - protein, 16 aa, Artificial Sequence
  B17B852_G34K HC KABAT CDR2
YISYDGSNNYNPSLKS

SEQ ID NO: 1103 - protein, 11 aa, Artificial Sequence
  B17B852_G34K HC KABAT CDR3
PSPGTGYAVDY

SEQ ID NO: 1104 - protein, 8 aa, Artificial Sequence
  B17B852_G34K HC CHOTHIA CDR1
GYSITSGY

SEQ ID NO: 1105 - protein, 5 aa, Artificial Sequence
  B17B852_G34K HC CHOTHIA CDR2
SYDGS

SEQ ID NO: 1106 - protein, 11 aa, Artificial Sequence
  B17B852_G34K HC CHOTHIA CDR3
PSPGTGYAVDY

SEQ ID NO: 1107 - protein, 9 aa, Artificial Sequence
  B17B852_G34K HC IMGT CDR1
GYSITSGYF

SEQ ID NO: 1108 - protein, 7 aa, Artificial Sequence
  B17B852_G34K HC IMGT CDR2
ISYDGSN

SEQ ID NO: 1109 - protein, 13 aa, Artificial Sequence
  B17B852_G34K HC IMGT CDR3
ASPSPGTGYAVDY

SEQ ID NO: 1110 - protein, 7 aa, Artificial Sequence
  B17B852_G34K HC CONTACT CDR1
TSGYFWN

SEQ ID NO: 1111 - protein, 12 aa, Artificial Sequence
  B17B852_G34K HC CONTACT CDR2
WMGYISYDGSNN

SEQ ID NO: 1112 - protein, 12 aa, Artificial Sequence
  B17B852_G34K HC CONTACT CDR3
ASPSPGTGYAVD

SEQ ID NO: 1113 - protein, 16 aa, Artificial Sequence
  B17B852_G34K LC AbM CDR1
RSSQSLVHSNKNTYLH

SEQ ID NO: 1114 - protein, 7 aa, Artificial Sequence
  B17B852_G34K LC AbM CDR2
KVSNRFS

SEQ ID NO: 1115 - protein, 9 aa, Artificial Sequence
  B17B852_G34K LC AbM CDR3
SQSTHVPFT

SEQ ID NO: 1116 - protein, 16 aa, Artificial Sequence
  B17B852_G34K LC KABAT CDR1
RSSQSLVHSNKNTYLH

SEQ ID NO: 1117 - protein, 7 aa, Artificial Sequence
  B17B852_G34K LC KABAT CDR2
KVSNRFS

SEQ ID NO: 1118 - protein, 9 aa, Artificial Sequence
  B17B852_G34K LC KABAT CDR3
SQSTHVPFT

SEQ ID NO: 1119 - protein, 16 aa, Artificial Sequence
  B17B852_G34K LC CHOTHIA CDR1
RSSQSLVHSNKNTYLH

SEQ ID NO: 1120 - protein, 7 aa, Artificial Sequence
  B17B852_G34K LC CHOTHIA CDR2
KVSNRFS

SEQ ID NO: 1121 - protein, 9 aa, Artificial Sequence
  B17B852_G34K LC CHOTHIA CDR3
SQSTHVPFT

SEQ ID NO: 1122 - protein, 11 aa, Artificial Sequence
  B17B852_G34K LC IMGT CDR1
QSLVHSNKNTY

SEQ ID NO: 1123 - protein, 3 aa, Artificial Sequence
  B17B852_G34K LC IMGT CDR2
KVS

SEQ ID NO: 1124 - protein, 9 aa, Artificial Sequence
  B17B852_G34K LC IMGT CDR3
SQSTHVPFT

SEQ ID NO: 1125 - protein, 12 aa, Artificial Sequence
  B17B852_G34K LC CONTACT CDR1
VHSNKNTYLHWY

SEQ ID NO: 1126 - protein, 10 aa, Artificial Sequence
  B17B852_G34K LC CONTACT CDR2
LLIYKVSNRF

SEQ ID NO: 1127 - protein, 8 aa, Artificial Sequence
  B17B852_G34K LC CONTACT CDR3
SQSTHVPF

SEQ ID NO: 1128 - protein, 120 aa, Artificial Sequence; identical to SEQ ID NO: 1032
  B17B852_G34K HC AA

SEQ ID NO: 1129 - protein, 112 aa, Artificial Sequence; identical to SEQ ID NO: 1065
  B17B852_G34K LC AA

SEQ ID NO: 1130 - protein, 484 aa, Artificial Sequence
  V7BCB31 Heavy Chain 1
DIQMTQSPSSLSASVGDRVTITCRSSQSLVHSNQNTYLHWYQQKPGKAPKLLIYKVSNRFSGVPSRFSGSGSGTDFTLTISSLQPEDFATYYCSQSTHVPFTFGQGTKLEIKGGSEGKSSGSGSESKSTGGSQVQLQESGPGLVKPSETLSLTCTVSGYSITSGYFWNWIRQFPGKGLEWIGYISYDGSNNYNPSLKSRVTISRDTSKNQFSLKLSSVTAADTAVYYCASPSPGTGYAVDYWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 1131 - protein, 484 aa, Artificial Sequence
  V7BCB32 Heavy Chain 1
DIQMTQSPSSLSASVGDRVTITCRSSQSLVHSNKNTYLHWYQQKPGKAPKLLIYKVSNRFSGVPSRFSGSGSGTDFTLTISSLQPEDFATYYCSQSTHVPFTFGQGTKLEIKGGSEGKSSGSGSESKSTGGSQVQLQESGPGLVKPSETLSLTCTVSGYSITSGYFWNWIRQFPGKGLEWIGYISYDGSNNYNPSLKSRVTISRDTSKNQFSLKLSSVTAADTAVYYCASPSPGTGYAVDYWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 1132 - protein, 484 aa, Artificial Sequence; identical to SEQ ID NO: 1131
  V7BCB33 Heavy Chain 1

SEQ ID NO: 1133 - protein, 484 aa, Artificial Sequence
  V7BCB34 Heavy Chain 1
DIQMTQSPSSLSASVGDRVTITCRSSQSLVHSTGNTYLHWYQQKPGKAPKLLIYKVSNRFSGVPSRFSGSGSGTDFTLTISSLQPEDFATYYCSQSTHVPFTFGQGTKLEIKGGSEGKSSGSGSESKSTGGSQVQLQESGPGLVKPSETLSLTCTVSGYSITSGYFWNWIRQFPGKGLEWMGYISYDGSNNYNPSLKSRITISRDTSKNQFSLKLSSVTAADTAVYYCASPSPGTGYAVDYWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 1134 - protein, 484 aa, Artificial Sequence; identical to SEQ ID NO: 1133
  V7BCB35 Heavy Chain 1

SEQ ID NO: 1135 - protein, 484 aa, Artificial Sequence
  V7BCB36 Heavy Chain 1
DIQMTQSPSSLSASVGDRVTITCRSSQSLVHSNRNTYLHWYQQKPGKAPKLLIYKVSNRFSGVPSRFSGSGSGTDFTLTISSLQPEDFATYYCSQSTHVPFTFGQGTKLEIKGGSEGKSSGSGSESKSTGGSQVQLQESGPGLVKPSETLSLTCTVSGYSITSGYFWNWIRQFPGKGLEWMGYISYDGSNNYNPSLKSRITISRDTSKNQFSLKLSSVTAADTAVYYCASPSPGTGYAVDYWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 1136 - protein, 484 aa, Artificial Sequence; identical to SEQ ID NO: 1135
  V7BCB37 Heavy Chain 1

SEQ ID NO: 1137 - protein, 484 aa, Artificial Sequence
  V7BCB38 Heavy Chain 1
DIQMTQSPSSLSASVGDRVTITCRSSQSLVHSNKNTYLHWYQQKPGKAPKLLIYKVSNRFSGVPSRFSGSGSGTDFTLTISSLQPEDFATYYCSQSTHVPFTFGQGTKLEIKGGSEGKSSGSGSESKSTGGSQVQLQESGPGLVKPSETLSLTCTVSGYSITSGYFWNWIRQFPGKGLEWMGYISYDGSNNYNPSLKSRITISRDTSKNQFSLKLSSVTAADTAVYYCASPSPGTGYAVDYWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 1138 - protein, 484 aa, Artificial Sequence; identical to SEQ ID NO: 1137
  V7BCB39 Heavy Chain 1

SEQ ID NO: 1139 - protein, 484 aa, Artificial Sequence
  V7BCB40 Heavy Chain 1
DIQMTQSPSSLSASVGDRVTITCRSSQSLVHSSGNTYLHWYQQKPGKAPKFLIYKVSNRFSGVPSRFSGSGSGTDFTLTISSLQPEDFATYYCSQSTHVPFTFGQGTKLEIKGGSEGKSSGSGSESKSTGGSQVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 1140 - protein, 484 aa, Artificial Sequence; identical to SEQ ID NO: 1139
  V7BCB41 Heavy Chain 1

SEQ ID NO: 1141 - protein, 476 aa, Artificial Sequence
  V7BCB42 Heavy Chain 1
DIQMTQSPSSLSASVGDRVTITCRASQSISSYLNWYQQKPGCAPKLLIYAASSLQSGVPSRFSGSGSGTDFTLTISSLQPEDFATYYCQQSYSTPLTFGQGTKVEIKGGGSGGSGGCPPCGGSGGEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYDGIYGELDFWGCGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNHYTQKSLSLSPGK

SEQ ID NO: 1142 - protein, 476 aa, Artificial Sequence; identical to SEQ ID NO: 1141
  V7BCB43 Heavy Chain 1

SEQ ID NO: 1143 - protein, 450 aa, Artificial Sequence
  V7BCB44 Heavy Chain 1
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPGK

SEQ ID NO: 1144 - protein, 450 aa, Artificial Sequence
  V7BCB45 Heavy Chain 1
QVQLQESGPGLVKPSETLSLTCTVSGYSITSGYFWNWIRQFPGKGLEWIGYISYDGSNNYNPSLKSRVTISRDTSKNQFSLKLSSVTAADTAVYYCASPSPGTGYAVDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPGK

SEQ ID NO: 1145 - protein, 450 aa, Artificial Sequence; identical to SEQ ID NO: 1144
  V7BCB46 Heavy Chain 1

SEQ ID NO: 1146 - protein, 450 aa, Artificial Sequence
  V7BCB47 Heavy Chain 1
QVQLQESGPGLVKPSETLSLTCTVSGYSITSGYFWNWIRQFPGKGLEWMGYISYDGSNNYNPSLKSRITISRDTSKNQFSLKLSSVTAADTAVYYCASPSPGTGYAVDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPGK

SEQ ID NO: 1147 - protein, 450 aa, Artificial Sequence; identical to SEQ ID NO: 1146
  V7BCB48 Heavy Chain 1

SEQ ID NO: 1148 - protein, 450 aa, Artificial Sequence; identical to SEQ ID NO: 1146
  V7BCB49 Heavy Chain 1

SEQ ID NO: 1149 - protein, 450 aa, Artificial Sequence
  V7BCB50 Heavy Chain 1
QVQLQESGPGLVKPSETLSLTCTVSGYSITSGYFWNWIRQPPGKGLEWIGYISYDGSNNYNPSLKSRVTISRDTSKNQFSLKLSSVTAADTAVYYCASPSPGTGYAVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVYPPSREEMTKNQVSLTCLVKGFYPSDIAVEWESNGQPENNYKTTPPVLDSDGSFALVSKLTVDKSRWQQGNVFSCSVMHEALHNRFTQKSLSLSPGK

SEQ ID NO: 1150 - protein, 450 aa, Artificial Sequence; identical to SEQ ID NO: 1144
  V7BCB51 Heavy Chain 1

SEQ ID NO: 1151 - protein, 450 aa, Artificial Sequence; identical to SEQ ID NO: 1144
  V7BCB52 Heavy Chain 1

SEQ ID NO: 1152 - protein, 450 aa, Artificial Sequence; identical to SEQ ID NO: 1146
  V7BCB53 Heavy Chain 1

SEQ ID NO: 1153 - protein, 450 aa, Artificial Sequence; identical to SEQ ID NO: 1146
  V7BCB54 Heavy Chain 1

SEQ ID NO: 1154 - protein, 450 aa, Artificial Sequence; identical to SEQ ID NO: 1146
  V7BCB55 Heavy Chain 1

SEQ ID NO: 1155 - protein, 450 aa, Artificial Sequence; identical to SEQ ID NO: 1149
  V7BCB56 Heavy Chain 1

SEQ ID NO: 1156 - protein, 450 aa, Artificial Sequence; identical to SEQ ID NO: 1143
  V7BCB57 Heavy Chain 1

SEQ ID NO: 1157 - protein, 218 aa, Artificial Sequence; identical to SEQ ID NO: 18
  V7BCB44 Light Chain 1

SEQ ID NO: 1158 - protein, 219 aa, Artificial Sequence
  V7BCB45 Light Chain 1
DIQMTQSPSSLSASVGDRVTITCRSSQSLVHSNQNTYLHWYQQKPGKAPKLLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1159 - protein, 219 aa, Artificial Sequence
  V7BCB46 Light Chain 1
DIQMTQSPSSLSASVGDRVTITCRSSQSLVHSNKNTYLHWYQQKPGKAPKLLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1160 - protein, 219 aa, Artificial Sequence
  V7BCB47 Light Chain 1
DIQMTQSPSSLSASVGDRVTITCRSSQSLVHSTGNTYLHWYQQKPGKAPKLLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1161 - protein, 219 aa, Artificial Sequence
  V7BCB48 Light Chain 1
DIQMTQSPSSLSASVGDRVTITCRSSQSLVHSNRNTYLHWYQQKPGKAPKLLIYKVSNRFSGVPSRFSGSGSGTDFTLTISSLQPEDFATYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1162 - protein, 219 aa, Artificial Sequence; identical to SEQ ID NO: 1159
  V7BCB49 Light Chain 1

SEQ ID NO: 1163 - protein, 219 aa, Artificial Sequence; identical to SEQ ID NO: 723
  V7BCB50 Light Chain 1

SEQ ID NO: 1164 - protein, 219 aa, Artificial Sequence; identical to SEQ ID NO: 1158
  V7BCB51 Light Chain 1

SEQ ID NO: 1165 - protein, 219 aa, Artificial Sequence; identical to SEQ ID NO: 1159
  V7BCB52 Light Chain 1

SEQ ID NO: 1166 - protein, 219 aa, Artificial Sequence; identical to SEQ ID NO: 1160
  V7BCB53 Light Chain 1

SEQ ID NO: 1167 - protein, 219 aa, Artificial Sequence; identical to SEQ ID NO: 1161
  V7BCB54 Light Chain 1

SEQ ID NO: 1168 - protein, 219 aa, Artificial Sequence; identical to SEQ ID NO: 1159
  V7BCB55 Light Chain 1

SEQ ID NO: 1169 - protein, 219 aa, Artificial Sequence; identical to SEQ ID NO: 723
  V7BCB56 Light Chain 1

SEQ ID NO: 1170 - protein, 218 aa, Artificial Sequence; identical to SEQ ID NO: 18
  V7BCB57 Light Chain 1

SEQ ID NO: 1171 - protein, 450 aa, Artificial Sequence
  V7BCB30 Heavy Chain 2
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNRFTQKSLSLSPGK

SEQ ID NO: 1172 - protein, 453 aa, Artificial Sequence
  V7BCB31 Heavy Chain 2
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDEGYSSGHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNRFTQKSLSLSPGK

SEQ ID NO: 1173 - protein, 450 aa, Artificial Sequence; identical to SEQ ID NO: 1171
  V7BCB32 Heavy Chain 2

SEQ ID NO: 1174 - protein, 453 aa, Artificial Sequence; identical to SEQ ID NO: 1172
  V7BCB33 Heavy Chain 2

SEQ ID NO: 1175 - protein, 450 aa, Artificial Sequence; identical to SEQ ID NO: 1171
  V7BCB34 Heavy Chain 2

SEQ ID NO: 1176 - protein, 453 aa, Artificial Sequence; identical to SEQ ID NO: 1172
  V7BCB35 Heavy Chain 2

SEQ ID NO: 1177 - protein, 450 aa, Artificial Sequence; identical to SEQ ID NO: 1171
  V7BCB36 Heavy Chain 2

SEQ ID NO: 1178 - protein, 453 aa, Artificial Sequence; identical to SEQ ID NO: 1172
  V7BCB37 Heavy Chain 2

SEQ ID NO: 1179 - protein, 450 aa, Artificial Sequence; identical to SEQ ID NO: 1171
  V7BCB38 Heavy Chain 2

SEQ ID NO: 1180 - protein, 453 aa, Artificial Sequence; identical to SEQ ID NO: 1172
  V7BCB39 Heavy Chain 2

SEQ ID NO: 1181 - protein, 450 aa, Artificial Sequence; identical to SEQ ID NO: 1171
  V7BCB40 Heavy Chain 2

SEQ ID NO: 1182 - protein, 453 aa, Artificial Sequence; identical to SEQ ID NO: 1172
  V7BCB41 Heavy Chain 2

SEQ ID NO: 1183 - protein, 450 aa, Artificial Sequence; identical to SEQ ID NO: 1171
  V7BCB42 Heavy Chain 2

SEQ ID NO: 1184 - protein, 453 aa, Artificial Sequence; identical to SEQ ID NO: 1172
  V7BCB43 Heavy Chain 2

SEQ ID NO: 1185 - protein, 484 aa, Artificial Sequence
  V7BCB44 Heavy Chain 2
EIVLTQSPGTLSLSPGERATLSCRASQSISSSFLTWYQQKPGQAPRLLIYGASSRATGIPDRFSGGGSGTDFTLTISRLEPEDFAVYYCQHYGSSPMYTFGQGTKLEIKGGSEGKSSGSGSESKSTGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDEGYSSGHYYGMDVWGQGTTVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 1186 - protein, 484 aa, Artificial Sequence; identical to SEQ ID NO: 1185
  V7BCB45 Heavy Chain 2

SEQ ID NO: 1187 - protein, 484 aa, Artificial Sequence; identical to SEQ ID NO: 1185
  V7BCB46 Heavy Chain 2

SEQ ID NO: 1188 - protein, 484 aa, Artificial Sequence; identical to SEQ ID NO: 1185
  V7BCB47 Heavy Chain 2

SEQ ID NO: 1189 - protein, 484 aa, Artificial Sequence; identical to SEQ ID NO: 1185
  V7BCB48 Heavy Chain 2

SEQ ID NO: 1190 - protein, 484 aa, Artificial Sequence; identical to SEQ ID NO: 1185
  V7BCB49 Heavy Chain 2

SEQ ID NO: 1191 - protein, 484 aa, Artificial Sequence; identical to SEQ ID NO: 1185
  V7BCB50 Heavy Chain 2

SEQ ID NO: 1192 - protein, 476 aa, Artificial Sequence
  V7BCB51 Heavy Chain 2
DIQMTQSPSSLSASVGDRVTITCRASQSISSYLNWYQQKPGCAPKLLIYAASSLQSGVPSRFSGSGSGTDFTLTISSLQPEDFATYYCQQSYSTPLTFGQGTKVEIKGGGSGGSGGCPPCGGSGGEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKYDGIYGELDFWGCGTLVTVSSEPKSSDKTHTCPPCPAPEAAGGPSVFLFPPKPKDTLMISRTPEVTCVVVSVSHEDPEVKFNWYVDGVEVHNAKTKPREEQYNSTYRVVSVLTVLHQDWLNGKEYKCKVSNKALPAPIEKTISKAKGQPREPQVYVLPPSREEMTKNQVSLLCLVKGFYPSDIAVEWESNGQPENNYLTWPPVLDSDGSFFLYSKLTVDKSRWQQGNVFSCSVMHEALHNHYTQKSLSLSPGK

SEQ ID NO: 1193 - protein, 476 aa, Artificial Sequence; identical to SEQ ID NO: 1192
  V7BCB52 Heavy Chain 2

SEQ ID NO: 1194 - protein, 476 aa, Artificial Sequence; identical to SEQ ID NO: 1192
  V7BCB53 Heavy Chain 2

SEQ ID NO: 1195 - protein, 476 aa, Artificial Sequence; identical to SEQ ID NO: 1192
  V7BCB54 Heavy Chain 2

SEQ ID NO: 1196 - protein, 476 aa, Artificial Sequence; identical to SEQ ID NO: 1192
  V7BCB55 Heavy Chain 2

SEQ ID NO: 1197 - protein, 476 aa, Artificial Sequence; identical to SEQ ID NO: 1192
  V7BCB56 Heavy Chain 2

SEQ ID NO: 1198 - protein, 476 aa, Artificial Sequence; identical to SEQ ID NO: 1192
  V7BCB57 Heavy Chain 2

SEQ ID NO: 1199 - protein, 218 aa, Artificial Sequence; identical to SEQ ID NO: 18
  V7BCB30 Light Chain 2

SEQ ID NO: 1200 - protein, 216 aa, Artificial Sequence
  V7BCB31 Light Chain 2
EIVLTQSPGTLSLSPGERATLSCRASQSISSSFLTWYQQKPGQAPRLLIYGASSRATGIPDRFSGGGSGTDFTLTISRLEPEDFAVYYCQHYGSSPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1201 - protein, 218 aa, Artificial Sequence; identical to SEQ ID NO: 18
  V7BCB32 Light Chain 2

SEQ ID NO: 1202 - protein, 216 aa, Artificial Sequence; identical to SEQ ID NO: 1200
  V7BCB33 Light Chain 2

SEQ ID NO: 1203 - protein, 218 aa, Artificial Sequence; identical to SEQ ID NO: 18
  V7BCB34 Light Chain 2

SEQ ID NO: 1204 - protein, 216 aa, Artificial Sequence; identical to SEQ ID NO: 1200
  V7BCB35 Light Chain 2

SEQ ID NO: 1205 - protein, 218 aa, Artificial Sequence; identical to SEQ ID NO: 18
  V7BCB36 Light Chain 2

SEQ ID NO: 1206 - protein, 216 aa, Artificial Sequence; identical to SEQ ID NO: 1200
  V7BCB37 Light Chain 2

SEQ ID NO: 1207 - protein, 218 aa, Artificial Sequence; identical to SEQ ID NO: 18
  V7BCB38 Light Chain 2

SEQ ID NO: 1208 - protein, 216 aa, Artificial Sequence; identical to SEQ ID NO: 1200
  V7BCB39 Light Chain 2

SEQ ID NO: 1209 - protein, 218 aa, Artificial Sequence; identical to SEQ ID NO: 18
  V7BCB40 Light Chain 2

SEQ ID NO: 1210 - protein, 216 aa, Artificial Sequence; identical to SEQ ID NO: 1200
  V7BCB41 Light Chain 2

SEQ ID NO: 1211 - protein, 218 aa, Artificial Sequence; identical to SEQ ID NO: 18
  V7BCB42 Light Chain 2

SEQ ID NO: 1212 - protein, 216 aa, Artificial Sequence; identical to SEQ ID NO: 1200
  V7BCB43 Light Chain 2

SEQ ID NO: 1213 - protein, 484 aa, Artificial Sequence; identical to SEQ ID NO: 1130
  V7BCB30 Heavy Chain 1

What is claimed is:

1. An antibody that binds to Vβ17, comprising:
   (i) a VH comprising a VH CDR1, a VH CDR2, and a VH CDR3 having the amino acid sequence of the VH CDR1, the VH CDR2, and the VH CDR3, respectively, of a heavy chain having the amino acid sequence of SEQ ID NO: 932; and
   (ii) a VL comprising a VL CDR1, a VL CDR2, and a VL CDR3 having the amino acid sequence of the VL CDR1, the VL CDR2, and the VL CDR3, respectively, of a light chain having the amino acid sequence of SEQ ID NO: 933.

2. The antibody of claim 1, wherein the antibody is a multispecific antibody.

3. The antibody of claim 1, wherein the antibody is multivalent, and wherein the antibody is capable of binding
   (i) at least three antigens;
   (ii) at least four antigens; or
   (iii) at least five antigens.

4. A multispecific antibody, comprising
   (i) a first binding domain that binds to Vβ17, wherein the first binding domain comprises:
      (a) a VH comprising a VH CDR1, a VH CDR2, and a VH CDR3 having the amino acid sequence of the VH CDR1, the VH CDR2, and the VH CDR3, respectively, of a heavy chain having the amino acid sequence of SEQ ID NO: 932; and
      (b) a VL comprising a VL CDR1, a VL CDR2, and a VL CDR3 having the amino acid sequence of the VL CDR1, the VL CDR2, and the VL CDR3, respectively, of a light chain having the amino acid sequence of SEQ ID NO: 933; and
   (ii) a second binding domain that binds to a second target that is CD123, BCMA, DLL3, PSMA or KLK2.

5. The multispecific antibody of claim 4, wherein the second target is CD123.

6. The multispecific antibody of claim 4, wherein
   (i) the VH CDR1, VH CDR2, VH CDR3, VL CDR1, VL CDR2, and VL CDR3 amino acid sequences of the first binding domain are according to the Kabat numbering system;
   (ii) the VH CDR1, VH CDR2, VH CDR3, VL CDR1, VL CDR2, and VL CDR3 amino acid sequences of the first binding domain are according to the Chothia numbering system;
   (iii) the VH CDR1, VH CDR2, VH CDR3, VL CDR1, VL CDR2, and VL CDR3 amino acid sequences of the first binding domain are according to the AbM numbering system;
   (iv) the VH CDR1, VH CDR2, VH CDR3, VL CDR1, VL CDR2, and VL CDR3 amino acid sequences of the first binding domain are according to the Contact numbering system;
   (v) the VH CDR1, VH CDR2, VH CDR3, VL CDR1, VL CDR2, and VL CDR3 amino acid sequences of the first binding domain are according to the IMGT numbering system; or
   (vi) the VH CDR1, VH CDR2, VH CDR3, VL CDR1, VL CDR2, and VL CDR3 amino acid sequences of the first binding domain are according to the Exemplary numbering system.

7. The multispecific antibody of claim 4, wherein the second target is BCMA.

8. The multispecific antibody of claim 4, wherein the second target is DLL3.

9. The multispecific antibody of claim 4, wherein the second target is PSMA.

10. The multispecific antibody of claim 4, wherein the second target is KLK2.

11. A nucleic acid encoding the antibody of claim 1.

12. A vector comprising the nucleic acid of claim 11.

13. A host cell comprising the vector of claim 12.

14. A pharmaceutical composition comprising the antibody of claim 1, and a pharmaceutically acceptable carrier.

15. A method of producing the pharmaceutical composition of claim 14, comprising combining the antibody with the pharmaceutically acceptable carrier to obtain the pharmaceutical composition.

16. A method of activating a T cell expressing Vβ17, comprising contacting the T cell with the antibody of claim 1.

17. A method of directing a T cell expressing Vβ17 to a target cell, comprising contacting the multispecific antibody of claim 4 with the target cell, wherein the second target is present on the surface of the target cell, and wherein the contacting directs the T cell to the target cell.

18. A method of inhibiting the growth or proliferation of a target cell, comprising contacting the multispecific antibody of claim 4 with the target cell having the second target present on the surface of the target cell, wherein the contacting is in the presence of a T cell expressing the Vβ17, and wherein the contacting results in the inhibition of the growth or proliferation of the target cell.

19. A method of eliminating a target cell in a subject, comprising contacting the multispecific antibody of claim 4 with the target cell having the second target present on the surface of the target cell, wherein the contacting is in the presence of a T cell expressing the Vβ17, and wherein the contacting results in the elimination of the target cell.

20. A method of treating a disease in a subject, comprising administering an effective amount of the multispecific antibody of claim 4 to the subject, wherein the disease is caused all or in part by a target cell having the second target present on the surface of the target cell.

21. The multispecific antibody of claim 4, wherein the second target is present on the surface of a target cell and is a cell of an adrenal cancer, anal cancer, appendix cancer, bile duct cancer, bladder cancer, bone cancer, brain cancer, breast cancer, cervical cancer, colorectal cancer, esophageal cancer, gallbladder cancer, gestational trophoblastic, head and neck cancer, Hodgkin lymphoma, intestinal cancer, kidney cancer, leukemia, liver cancer, lung cancer, melanoma, mesothelioma, multiple myeloma, neuroendocrine tumor, non-Hodgkin lymphoma, oral cancer, ovarian cancer, pancreatic cancer, prostate cancer, sinus cancer, skin cancer, soft tissue sarcoma spinal cancer, stomach cancer, testicular cancer, throat cancer, thyroid cancer, uterine cancer endometrial cancer, vaginal cancer, or vulvar cancer.

22. The antibody of claim 1, wherein the antibody is a humanized antibody.

23. The antibody of claim 1, wherein the antibody is an IgG antibody.

24. The antibody of claim 1, wherein the antibody comprises a kappa light chain, a lambda light chain, or both.

25. The antibody of claim 1, wherein the antibody is a monoclonal antibody.

26. The multispecific antibody of claim 4, wherein the second target is present on the surface of a target cell, and the target cell is a B cell.

27. The multispecific antibody of claim 5, wherein the second binding domain that binds CD123 comprises:
(i) a VH comprising a VH CDR1, a VH CDR2, and a VH CDR3 having the amino acid sequence of the VH CDR1, the VH CDR2, and the VH CDR3, respectively, of a VH having the amino acid sequence of SEQ ID NO:40; and
(ii) a VL comprising a VL CDR1, a VL CDR2, and a VL CDR3 having the amino acid sequence of the VL CDR1, the VL CDR2, and the VL CDR3, respectively, of a VL having the amino acid sequence of SEQ ID NO:41.

28. The multispecific antibody of claim 7, wherein the second binding domain that binds BCMA comprises:
(i) a VH comprising a VH CDR1, a VH CDR2, and a VH CDR3 having the amino acid sequence of the VH CDR1, the VH CDR2, and the VH CDR3, respectively, of a VH having the amino acid sequence of SEQ ID NO:95; and
(ii) a VL comprising a VL CDR1, a VL CDR2, and a VL CDR3 having the amino acid sequence of the VL CDR1, the VL CDR2, and the VL CDR3, respectively, of a VL having the amino acid sequence of SEQ ID NO:96.

29. The multispecific antibody of claim 8, wherein the second binding domain that binds DLL3 comprises:
(i) a VH comprising a VH CDR1, a VH CDR2, and a VH CDR3 having the amino acid sequence of the VH CDR1, the VH CDR2, and the VH CDR3, respectively, of a VH having the amino acid sequence of SEQ ID NO:694; and
(ii) a VL comprising a VL CDR1, a VL CDR2, and a VL CDR3 having the amino acid sequence of the VL CDR1, the VL CDR2, and the VL CDR3, respectively, of a VL having the amino acid sequence of SEQ ID NO:695.

30. The multispecific antibody of claim 9, wherein the second binding domain that binds PSMA comprises:
(i) (a) a VH comprising a VH CDR1, a VH CDR2, and a VH CDR3 having the amino acid sequence of the VH CDR1, the VH CDR2, and the VH CDR3, respectively, of a VH having the amino acid sequence of SEQ ID NO:730; and (b) a VL comprising a VL CDR1, a VL CDR2, and a VL CDR3 having the amino acid sequence of the VL CDR1, the VL CDR2, and the VL CDR3, respectively, of a VL having the amino acid sequence of SEQ ID NO:731;
(ii) (a) a VH comprising a VH CDR1, a VH CDR2, and a VH CDR3 having the amino acid sequence of the VH CDR1, the VH CDR2, and the VH CDR3, respectively, of a VH having the amino acid sequence of SEQ ID NO:732; and (b) a VL comprising a VL CDR1, a VL CDR2, and a VL CDR3 having the amino acid sequence of the VL CDR1, the VL CDR2, and the VL CDR3, respectively, of a VL having the amino acid sequence of SEQ ID NO:733;
(iii) (a) a VH comprising a VH CDR1, a VH CDR2, and a VH CDR3 having the amino acid sequence of the VH CDR1, the VH CDR2, and the VH CDR3, respectively, of a VH having the amino acid sequence of SEQ ID NO:734; and (b) a VL comprising a VL CDR1, a VL CDR2, and a VL CDR3 having the amino acid sequence of the VL CDR1, the VL CDR2, and the VL CDR3, respectively, of a VL having the amino acid sequence of SEQ ID NO:735;
(iv) (a) a VH comprising a VH CDR1, a VH CDR2, and a VH CDR3 having the amino acid sequence of the VH CDR1, the VH CDR2, and the VH CDR3, respectively, of a VH having the amino acid sequence of SEQ ID NO:736; and (b) a VL comprising a VL CDR1, a VL CDR2, and a VL CDR3 having the amino acid sequence of the VL CDR1, the VL CDR2, and the VL CDR3, respectively, of a VL having the amino acid sequence of SEQ ID NO:737; or
(v) (a) a VH comprising a VH CDR1, a VH CDR2, and a VH CDR3 having the amino acid sequence of the VH CDR1, the VH CDR2, and the VH CDR3, respectively, of a VH having the amino acid sequence of SEQ ID NO:899; and (b) a VL comprising a VL CDR1, a VL CDR2, and a VL CDR3 having the amino acid sequence of the VL CDR1, the VL CDR2, and the VL CDR3, respectively, of a VL having the amino acid sequence of SEQ ID NO:900.

31. The multispecific antibody of claim 10, wherein the second binding domain that binds KLK2 comprises:
   (i) a VH comprising a VH CDR1, a VH CDR2, and a VH CDR3 having the amino acid sequence of the VH CDR1, the VH CDR2, and the VH CDR3, respectively, of a VH having the amino acid sequence of SEQ ID NO:887; and
   (ii) a VL comprising a VL CDR1, a VL CDR2, and a VL CDR3 having the amino acid sequence of the VL CDR1, the VL CDR2, and the VL CDR3, respectively, of a VL having the amino acid sequence of SEQ ID NO:888.

32. The method of claim 16, wherein the contacting results in an increase in CD69, CD25, and/or Granzyme B expression, as compared to a control T cell expressing Vβ17 not contacted with the antibody.

33. The method of claim 17, wherein the target cell is a B cell.

34. The multispecific antibody of claim 21, wherein
   (i) the adrenal cancer is an adrenocortical carcinoma (ACC), adrenal cortex cancer, pheochromocytoma, or neuroblastoma;
   (ii) the anal cancer is a squamous cell carcinoma, cloacogenic carcinoma, adenocarcinoma, basal cell carcinoma, or melanoma;
   (iii) the appendix cancer is a neuroendocrine tumor (NET), mucinous adenocarcinoma, goblet cell carcinoid, intestinal-type adenocarcinoma, or signet-ring cell adenocarcinoma;
   (iv) the bile duct cancer is an extrahepatic bile duct cancer, adenocarcinomas, hilar bile duct cancer, perihilar bile duct cancer, distal bile duct cancer, or intrahepatic bile duct cancer;
   (v) the bladder cancer is transitional cell carcinoma (TCC), papillary carcinoma, flat carcinoma, squamous cell carcinoma, adenocarcinoma, small-cell carcinoma, or sarcoma;
   (vi) the bone cancer is a primary bone cancer, sarcoma, osteosarcoma, chondrosarcoma, sarcoma, fibrosarcoma, malignant fibrous histiocytoma, giant cell tumor of bone, chordoma, or metastatic bone cancer;
   (vii) the brain cancer is an astrocytoma, brain stem glioma, glioblastoma, meningioma, ependymoma, oligodendroglioma, mixed glioma, pituitary carcinoma, pituitary adenoma, craniopharyngioma, germ cell tumor, pineal region tumor, medulloblastoma, or primary CNS lymphoma;
   (viii) the breast cancer is a breast adenocarcinoma, invasive breast cancer, noninvasive breast cancer, breast sarcoma, metaplastic carcinoma, adenocystic carcinoma, phyllodes tumor, angiosarcoma, HER2-positive breast cancer, triple-negative breast cancer, or inflammatory breast cancer;
   (ix) the cervical cancer is a squamous cell carcinoma, or adenocarcinoma;
   (x) the colorectal cancer is a colorectal adenocarcinoma, primary colorectal lymphoma, gastrointestinal stromal tumor, leiomyosarcoma, carcinoid tumor, mucinous adenocarcinoma, signet ring cell adenocarcinoma, gastrointestinal carcinoid tumor, or melanoma;
   (xi) the esophageal cancer is an adenocarcinoma or squamous cell carcinoma;
   (xii) the gall bladder cancer is an adenocarcinoma, papillary adenocarcinoma, adenosguamous carcinoma, squamous cell carcinoma, small cell carcmoma, or sarcoma;
   (xiii) the gestational trophoblastic disease (GTD) is a hydatidiform mole, gestational trophoblastic neoplasia (GTN), choriocarcinoma, placental-site trophoblastic tumor (PSTT), or epithelioid trophoblastic tumor (ETT);
   (xiv) the head and neck cancer is a laryngeal cancer, nasopharyngeal cancer, hypopharyngeal cancer, nasal cavity cancer, paranasal sinus cancer, salivary gland cancer, oral cancer, oropharyngeal cancer, or tonsil cancer;
   (xv) the Hodgkin lymphoma is a classical Hodgkin lymphoma, nodular sclerosis, mixed cellularity, lymphocyte-rich, lymphocyte-depleted, or nodular lymphocyte-predominant Hodgkin lymphoma (NLPHL);
   (xvi) the intestinal cancer is a small intestine cancer, small bowel cancer, adenocarcinoma, sarcoma, gastrointestinal stromal tumors, carcinoid tumors, or lymphoma;
   (xvii) the kidney cancer is a renal cell carcinoma (RCC), clear cell RCC, papillary RCC, chromophobe RCC, collecting duct RCC, unclassified RCC, transitional cell carcinoma, urothelial cancer, renal pelvis carcinoma, or renal sarcoma;
   (xviii) the leukemia is an acute lymphocytic leukemia (ALL), acute myeloid leukemia (AML), chronic lymphocytic leukemia (CLL), chronic myeloid leukemia (CIVIL), hairy cell leukemia (HCL), or a myelodysplastic syndrome (MDS);
   (xix) the liver cancer is a hepatocellular carcinoma (HCC), fibrolamellar HCC, cholangiocarcinoma, angiosarcoma, or liver metastasis;
   (xx) the lung cancer is a small cell lung cancer, small cell carcinoma, combined small cell carcinoma, non-small cell lung cancer, lung adenocarcinoma, squamous cell lung cancer, large-cell undifferentiated carcinoma, pulmonary nodule, metastatic lung cancer, adenosquamous carcinoma, large cell neuroendocrine carcinoma, salivary gland-type lung carcinoma, lung carcinoid, mesothelioma, sarcomatoid carcinoma of the lung, or malignant granular cell lung tumor;
   (xxi) the melanoma is a superficial spreading melanoma, nodular melanoma, acral-lentiginous melanoma, lentigo maligna melanoma, amelanotic melanoma, desmoplastic melanoma, ocular melanoma, or metastatic melanoma;
   (xxii) the mesothelioma is a pleural mesothelioma, peritoneal mesothelioma, pericardial mesothelioma, or testicular mesothelioma;
   (xxiii) the multiple myeloma is an active myeloma or smoldering myeloma;
   (xxiv) the neuroendocrine tumor, is a gastrointestinal neuroendocrine tumor, pancreatic neuroendocrine tumor, or lung neuroendocrine tumor;
   (xxv) the non-Hodgkin's lymphoma is an anaplastic large-cell lymphoma, lymphoblastic lymphoma, peripheral T cell lymphoma, follicular lymphoma, cutaneous T cell lymphoma, lymphoplasmacytic lymphoma, marginal zone B-cell lymphoma, MALT lymphoma, small-cell lymphocytic lymphoma, Burkitt lymphoma, chronic lymphocytic leukemia (CLL), small lymphocytic lymphoma (SLL), precursor T-lymphoblastic leukemia/lymphoma, acute lymphocytic leukemia (ALL), adult T cell lymphoma/leukemia (ATLL), hairy cell leukemia, B-cell lymphomas, diffuse large B-cell lymphoma (DLBCL), primary mediastinal B-cell lymphoma, primary central nervous system (CNS) lymphoma, mantle cell lymphoma (MCL), marginal zone lymphomas, mucosa-associated lymphoid tissue (MALT) lymphoma, nodal marginal zone B-cell lymphoma, splenic marginal zone B-cell lymphoma, lymphoplasmacytic lymphoma, B-cell non-Hodgkin lymphoma, T cell non-Hodgkin lymphoma, natural killer cell lymphoma, cutaneous T cell lymphoma, Alibert-Bazin syndrome, Sezary syndrome, primary cutaneous anaplastic large-cell lymphoma, peripheral T cell lymphoma, angioimmunoblastic T cell lymphoma (AITL), anaplastic large-cell lymphoma (ALCL), systemic ALCL, enteropathy-type T cell lymphoma (EATL), or hepatosplenic gamma/delta T cell lymphoma;

(xxvi) the oral cancer is a squamous cell carcinoma, verrucous carcinoma, minor salivary gland carcinomas, lymphoma, benign oral cavity tumor, eosinophilic granuloma, fibroma, granular cell tumor, karatoacanthoma, leiomyoma, osteochondroma, lipoma, schwannoma, neurofibroma, papilloma, condyloma *acuminatum*, verruciform xanthoma, pyogenic granuloma, rhabdomyoma, odontogenic tumors, leukoplakia, erythroplakia, squamous cell lip cancer, basal cell lip cancer, mouth cancer, gum cancer, or tongue cancer;

(xxvii) the ovarian cancer is a ovarian epithelial cancer, mucinous epithelial ovarian cancer, endometrioid epithelial ovarian cancer, clear cell epithelial ovarian cancer, undifferentiated epithelial ovarian cancer, ovarian low malignant potential tumors, primary peritoneal carcinoma, fallopian tube cancer, germ cell tumors, teratoma, dysgerminoma ovarian germ cell cancer, endodermal sinus tumor, sex cord-stromal tumors, sex cord-gonadal stromal tumor, ovarian stromal tumor, granulosa cell tumor, granulosa-theca tumor, Sertoli-Leydig tumor, ovarian sarcoma, ovarian carcinosarcoma, ovarian adenosarcoma, ovarian leiomyosarcoma, ovarian fibrosarcoma, Krukenberg tumor, or ovarian cyst;

(xxviii) the pancreatic cancer is a pancreatic exocrine gland cancer, pancreatic endocrine gland cancer, or pancreatic adenocarcinoma, islet cell tumor, or neuroendocrine tumor;

(xxix) the prostate cancer is a prostate adenocarcinoma, prostate sarcoma, transitional cell carcinoma, small cell carcinoma, or neuroendocrine tumor;

(xxx) the sinus cancer is a squamous cell carcinoma, mucosa cell carcinoma, adenoid cystic cell carcinoma, acinic cell carcinoma, sinonasal undifferentiated carcinoma, nasal cavity cancer, paranasal sinus cancer, maxillary sinus cancer, ethmoid sinus cancer, or nasopharynx cancer;

(xxxi) the skin cancer is a basal cell carcinoma, squamous cell carcinoma, melanoma, Merkel cell carcinoma, Kaposi sarcoma (KS), actinic keratosis, skin lymphoma, or keratoacanthoma;

(xxxii) the soft tissue cancer is an angiosarcoma, dermatofibrosarcoma, epithelioid sarcoma, Ewing's sarcoma, fibrosarcoma, gastrointestinal stromal tumors (GISTs), Kaposi sarcoma, leiomyosarcoma, liposarcoma, dedifferentiated liposarcoma (DL), myxoid/round cell liposarcoma (MRCL), well-differentiated liposarcoma (WDL), malignant fibrous histiocytoma, neurofibrosarcoma, rhabdomyosarcoma (RMS), or synovial sarcoma;

(xxxiii) the spinal cancer is a spinal metastatic tumor;

(xxxiv) the stomach cancer is a stomach adenocarcinoma, stomach lymphoma, gastrointestinal stromal tumors, carcinoid tumor, gastric carcinoid tumors, Type I ECL-cell carcinoid, Type II ECL-cell carcinoid, or Type III ECL-cell carcinoid;

(xxxv) the testicular cancer is a seminoma, non-seminoma, embryonal carcinoma, yolk sac carcinoma, choriocarcinoma, teratoma, gonadal stromal tumor, leydig cell tumor, or sertoli cell tumor;

(xxxvi) the throat cancer is a squamous cell carcinoma, adenocarcinoma, sarcoma, laryngeal cancer, pharyngeal cancer, nasopharynx cancer, oropharynx cancer, hypopharynx cancer, laryngeal cancer, laryngeal squamous cell carcinoma, laryngeal adenocarcinoma, lymphoepithelioma, spindle cell carcinoma, verrucous cancer, undifferentiated carcinoma, or lymph node cancer;

(xxxvii) the thyroid cancer is a papillary carcinoma, follicular carcinoma, Hürthle cell carcinoma, medullary thyroid carcinoma, or anaplastic carcinoma;

(xxxviii) the uterine cancer is an endometrial cancer, endometrial adenocarcinoma, endometroid carcinoma, serous adenocarcinoma, adenosguamous carcinoma, uterine carcinosarcoma, uterine sarcoma, uterine leiomyosarcoma, endometrial stromal sarcoma, or undifferentiated sarcoma;

(xxxix) the vaginal cancer is a squamous cell carcinoma, adenocarcinoma, melanoma, or sarcoma; or (xl) the vulvar cancer is a squamous cell carcinoma or adenocarcinoma.

\* \* \* \* \*